(12) United States Patent
Schwarz et al.

(10) Patent No.: US 9,493,804 B2
(45) Date of Patent: Nov. 15, 2016

(54) AGENTS AND METHODS FOR THE EXPRESSION AND SECRETION OF PEPTIDES AND PROTEINS

(71) Applicant: Heinrich-Heine-Universitaet Duesseldorf, Duesseldorf (DE)

(72) Inventors: Christian Schwarz, Duesseldorf (DE); Lutz Schmitt, Neuss (DE); Sander Hendrikus Joannes Smits, Duesseldorf (DE)

(73) Assignee: Heinrich-Heine-Universitaet Duesseldorf, Duesseldorf (DE)

( * ) Notice: Subject to any disclaimer, the term of this patent is extended or adjusted under 35 U.S.C. 154(b) by 387 days.

(21) Appl. No.: 14/353,270

(22) PCT Filed: Oct. 22, 2012

(86) PCT No.: PCT/EP2012/070880
§ 371 (c)(1),
(2) Date: Apr. 21, 2014

(87) PCT Pub. No.: WO2013/057312
PCT Pub. Date: Apr. 25, 2013

(65) Prior Publication Data
US 2014/0343251 A1    Nov. 20, 2014

(30) Foreign Application Priority Data
Oct. 21, 2011 (EP) .................... 11186225

(51) Int. Cl.
*C12P 21/00* (2006.01)
*C07K 14/425* (2006.01)
*C07K 14/56* (2006.01)
*C12P 21/02* (2006.01)
*C07K 14/245* (2006.01)

(52) U.S. Cl.
CPC .............. *C12P 21/00* (2013.01); *C07K 14/245* (2013.01); *C07K 14/56* (2013.01); *C12P 21/02* (2013.01); *C07K 2319/036* (2013.01); *C07K 2319/20* (2013.01); *C07K 2319/50* (2013.01)

(58) Field of Classification Search
None
See application file for complete search history.

(56) References Cited

U.S. PATENT DOCUMENTS

| | | | | |
|---|---|---|---|---|
| 2003/0165870 A1* | 9/2003 | Blattner | .................. | C12Q 1/689 435/6.14 |
| 2004/0219530 A1* | 11/2004 | Brousseau | ........... | C12Q 1/6837 506/9 |
| 2006/0094034 A1* | 5/2006 | Brousseau | ............. | C12Q 1/689 435/6.15 |
| 2011/0287037 A1* | 11/2011 | Gentschev | ............. | A61K 39/00 424/184.1 |

OTHER PUBLICATIONS

Ludwig, A., et al., 1996, "Analysis of the in vivo activation of Hemolysin (HlyA) from *Escherichia coli*", Journal of Bacteriology, vol. 178, No. 18, pp. 5422-5430.*

(Continued)

*Primary Examiner* — Nashaat Nashed
*Assistant Examiner* — William W Moore
(74) *Attorney, Agent, or Firm* — Seed IP Law Group LLP

(57) ABSTRACT

The present invention relates to a nucleic acid molecule for recombinant expression and secretion of a peptide or protein of interest comprising a hemolysin A and/or hemolysin C-derived nucleotide sequence, fragments thereof, homologs thereof, or the complements thereof, and a nucleotide sequence encoding the peptide or protein of interest.

24 Claims, 17 Drawing Sheets

(56) References Cited

OTHER PUBLICATIONS

Burgos, Y. K., et al., 2009, "Characterization of the α-haemolysin determinant fromthe human enteropathogenic*Escherichia coli* O26 plasmid pEO5", FEMS Microbiology Letters, vol. 292, No. 1, pp. 194-2002.*

Bakkes et al., "The Rate of Folding Dictates Substrate Secretion by the *Escherichia coli* Hemolysin Type 1 Secretion System," *J. Biol. Chem.* 285(52):40573-40580, Dec. 24, 2010.

Baumann et al., "Three-dimensional structure of the alkaline protease of *Pseudomonas aeruginosa*: a two-domain protein with a calcium binding parallel beta roll motif," *The EMBO Journal* 12(9):3357-3364, 1993.

Bittker et al., "Nucleic acid evolution and minimization by nonhomologus random recombination," *Nature Biotechnology* 20:1024-1029, Oct. 2002.

Blight et al., "Heterologous protein secretion and the versatile *Escherichia coli* haemolysin translocator," *Trends Biotechnol.* 12(11):450-455, Nov. 1994.

Chervaux et al., "Secretion of active β-lactamase to the medium mediated by the *Escherichia coli* haemolysin transport pathway," *Mol. Gen. Genet.* 249(2):237-245, 1995.

"*Escherichia coli* hlyC gene, strain 84-2573," Database accession No. FM210349, XP-002689446, created Sep. 11, 2009, retrieved from http://ibis/exam/dbfetch/jsp?id=EM_STD:FM210349 on Dec. 18, 2012, 1 page.

"*Escherichia coli* strain DEC7a hemolysin C (hlyCA) gene, partial cds.," Database accession No. AY525539, XP-002689447, created Jan. 31, 2005, retrieved from http://ibis/exam/dbfetch.jsp?id=EM_STD:AY525539 on Dec. 18, 2012, 1 page.

Gentschev et al., "Development of antigen-delivery systems, based on the *Escherichia coli* hemolysin secretion pathway," *Gene* 179(1):133-140, 1996.

Härtlein et al., "Transport of Hemolysin by *Escherichia coli*," *Journal of Cellular Biochemistry* 22:87-97, 1983.

Hess et al., "Analysis of the haemolysin secretion system by PhoA-HlyA fusion proteins," *Mol. Gen. Genet.* 224(2): 201-208, 1990.

"interferon alpha-2 precursor [*Homo sapiens*]," NCBI Reference Sequence: NP_000596.2, retrieved from http://www.ncbi.nlm.nih.gov/protein/NP_000596.2 on Dec. 4, 2014, 2 pages.

Jenewein, "The *Escherichia coli* haemolysin transporter: A paradigm for Type I secretion," dissertation, Heinrich-Heine-Universität Düsseldorf, 2008, 195 pages.

Jumpertz et al., "Mutations affecting the extreme C terminus of *Escherichia coli* haemolysin A reduce haemolytic activity by altering the folding of the toxin," *Microbiology* 156:2495-2505, 2010.

Li et al., "Cloning and hemolysin-mediated secretory expression of a codon-optimized synthetic human interleukin-6 gene in *Escherichia coli*," *Protein Expression and Purification* 25:437-447, 2002.

Meier et al., "A Calcium-gated Lid and a Large β-Roll Sandwich Are Revealed by the Crystal Structure of Extracellular Lipases from *Serratia marcescens*," *J. Biol. Chem.* 282(43):31477-31483, Oct. 26, 2007.

Mollenkopf et al., "Conversion of Bacterial Gene Products to Secretion-Competent Fusion Proteins," *BioTechniques* 21(5):854-860, 1996.

Murakami et al., "Random insertion and deletion of arbitrary No. Of bases for codon-based random mutation of DNAs," *Nature Biotechnology* 20:76-81, Jan. 2002.

Nicaud et al., "Characterisation of HlyC and mechanism of activation and secretion of haemolysin from *E. coli* 2001," *FEBS Lett.* 187(2):339-344, Aug. 1985.

Reetz et al., "Addressing the Numbers Problem in Directed Evolution," *ChemBioChem* 9:1797-1804, 2008.

Sanchis et al., "Improved PCR method for the creation of saturation mutagenesis libraries in directed evolution: application to difficult-to-amplify templates," *Appl. Microbiol. Biotechnol.* 81:387-397, 2008.

Virnekäs et al., "Trinucleotide phosphoramidites: ideal reagents for the synthesis of mixed oligonucleotides for random mutagenesis," *Nucleic Acids Research* 22(25):5600-5607, 1994.

Wang et al., "Expanding the Genetic Code of *Escherichia coli*," *Science* 292:498-500, 2001.

Wang et al., "Expanding the genetic code," *Chem. Commun.*, pp. 1-11, 2002.

Zaccolo et al., "An Approach to Random Mutagenesis of DNA Using Mixtures of Triphosphate Derivatives of Nucleoside Analogues," *J. Mol. Bio.* 255:589-603, 1996.

* cited by examiner

Figures pSU-HlyA1 minC (ΔATG):

pSU-HlyA1 5/11 Gap:

pSU-HlyA1 8/11 Gap:

pSU-HlyA1 +Gap:

pSU-HlyA1 Gap +6:

pSU-HlyA1 Gap +12:

pSU-HlyA1 Gap +21:

pSU-HlyA1 Gap +30:

pSU-HlyA1 Gap +51:

pSU-HlyA1 Gap +72:

pSU-HlyA1 Gap +93:

pSU-HlyA1:

US 9,493,804 B2

AGENTS AND METHODS FOR THE EXPRESSION AND SECRETION OF PEPTIDES AND PROTEINS

FIELD OF THE INVENTION

The present invention lies in the field of molecular biology, recombinant peptide and protein expression and relates to nucleic acid sequences comprising hemolysin C and/or hemolysin A gene fragments to improve the expression and secretion of a peptide or protein of interest.

BACKGROUND OF THE INVENTION

In recent years recombinant protein/enzyme production for use in industrial processes has become more and more important and it is expected that soon many industrial processes will involve recombinant technologies.

However, the expression of recombinant peptides and proteins is still limited, as large efforts are required in order to obtain the desired peptides and proteins with a native fold, in high amounts and high purity.

Generally, product purification is expensive and especially the final step to 100% purity tends to increase the costs exponentially. Especially proteins present a particular problem in downstream recovery because they are difficult to separate from one another and are liable to degradation and denaturation (Hacking, A. J. (1986) Economic aspects of biotechnology, Cambridge University Press). To some extent protein secretion approaches have been developed, wherein the desired protein is expressed in a host cell and exported to the extracellular space, in order to circumvent laborious protein purification starting from raw lysate. However, many protein secretion pathways involve proteolytic degradation of the transported polypeptide, leading to at least partially fragmented peptide or protein product or incomplete secretion of the peptide or protein of interest, e.g., due to arrest of the polypeptides in the periplasm. Therefore, Type 1 secretion systems (T1SS), which mostly occur in Gram-negative bacteria, are currently under investigation, as they export their cognate substrates in a single step from the cytosol to the extracellular medium without the formation of periplasmic substrate intermediates, which often undergo at least partial periplasmic proteolysis. Among the family of T1 SS the hemolysin (Hly) T1SS described by Bakkes et al. involving HlyA as transport substrate is of particular interest, as it is devoid of any proteolytic activity (Bakkes et al. (2010), J. Biol. Chem.; 285(52):40573-80) and thus does not degrade the secreted peptide or protein of interest. The hemolysin (Hly) T1SS of *E. coli* consists of the inner membrane protein HlyB, which is an ATP binding cassette (ABC) transporter, the outer membrane protein TolC and the membrane fusion protein HlyD in the inner membrane. The interacting substrate HlyA is exported through the hemolysin secretion system in an ATP dependent manner. Even though large efforts have been made so far, the Hly T1S system is still not industrially used, as the yields of expressed and secreted peptides or proteins are still too low for application in any commercially relevant process.

Particularly, the recombinant production of large quantities of peptides with high purities is still limited, so that the current production methods for peptides still mostly rely on cost intensive chemical synthesis.

There is still need in the art for methods that allow efficient production of a recombinant peptide or protein of interest.

SUMMARY OF THE INVENTION

In a first aspect, the present invention relates to an isolated nucleic acid molecule comprising, consisting essentially of or consisting of a first nucleic acid sequence, wherein the first nucleic acid sequence comprises a fragment of the nucleotide sequence encoding for hemolysin C (HlyC) (i) has the nucleotide sequence as set forth in SEQ ID NO:1 or a 3" fragment thereof, wherein the fragment comprises at least the nucleotide sequence as set forth in SEQ ID NO:2, or the complement thereof, or (ii) has a nucleotide sequence that has at least 70% sequence identity to the nucleotide sequence as defined in i).

The first nucleic acid sequence is not a sequence encoding full length HlyC and the isolated nucleic acid molecule of the invention does not include a nucleotide sequence encoding full length HlyC, as for example set forth in SEQ ID NO:158 or a complement thereof.

In the isolated nucleic acid molecule the first nucleic acid sequence may have a nucleotide sequence selected from the group consisting of SEQ ID Nos. 2-27 and 3" fragments thereof, wherein the fragments comprise at least the sequence as set forth in SEQ ID NO:2, or the complements thereof.

In various embodiments of the first aspect, the isolated nucleic acid molecule comprises, consists essentially of or consists of a first and a second nucleic acid sequence, wherein the first nucleic acid sequence is defined as above; and the second nucleic acid sequence encodes for at least one peptide or protein of interest and is located 3" of the first nucleic acid sequence.

In preferred embodiments, the isolated nucleic acid molecule of the invention further comprises a third nucleic acid sequence located 3" of the first nucleic acid sequence and 5" or 3" of the second nucleic acid sequence or flanking the second nucleic acid sequence in that the second nucleic acid sequence is inserted into the third nucleic acid sequence, wherein the third nucleic acid is operably linked with the second nucleic acid sequence and encodes for hemolysin A (HlyA) or a fragment thereof. In various embodiments, the third nucleic acid sequence (i) has the nucleotide sequence as set forth in SEQ ID NO:29 or a fragment thereof, wherein the fragment comprises at least the nucleotide sequence as set forth in SEQ ID NO:30, or the complement thereof, or (ii) has a nucleotide sequence that has at least 70% sequence identity to the third nucleic acid sequence as defined in i); or (iii) has a nucleotide sequence that encodes for a polypeptide which has at least 91% sequence homology to the polypeptide encoded by the nucleotide sequence as defined in (i).

In various embodiments, the third nucleic acid sequence has a nucleotide sequence selected from the group consisting of SEQ ID Nos. 30-40, and fragments thereof, wherein the fragments comprise at least the sequence as set forth in SEQ ID NO:30, and the complements thereof.

The isolated nucleic acid molecule of the invention may thus comprise a combination of first and third nucleic acid sequences as defined above. In various embodiments, the first nucleic acid sequence has a nucleotide sequence selected from the group consisting of SEQ ID Nos. 1-27 or the complements thereof and the third nucleic acid sequence has a nucleotide sequence selected from the group consisting of SEQ ID Nos. 29-40.

In still further embodiments, the isolated nucleic acid molecule may further comprise at least one fourth nucleic acid sequence encoding for (i) an affinity tag, wherein the nucleotide sequence encoding the affinity tag is operably linked to the 5" or 3" end of the second or third nucleic acid sequence; and/or (ii) a protease cleavage site, wherein the nucleotide sequence encoding the protease cleavage site is operably linked to the second nucleic acid molecule and the third nucleic acid molecule such that it is located between second and third nucleic acid sequence. In embodiments, where the second nucleic acid sequence is inserted into the third nucleic acid sequence, the sequence encoding the protease cleavage site can be at either end of the second nucleic acid linked to a part of the third nucleic acid sequence or both ends can comprise a sequence encoding a protease cleavage site.

In various embodiments, the isolated nucleic acid molecule of the invention, comprises, consists essentially of or consists of a nucleic acid sequence as set forth in any one of SEQ ID Nos. 66, 71, 74, 79, 84, 89, 93, 98, 103, 110, 115, 120, 125, 130, 135, 140, 145, 220, 227, 234, 239, 244, 249, 254, 259, 264, 269, 274, 279, 284, 289, 294, 299, 304, 325, 327, 329, and 331.

In a further aspect, the present invention relates to a vector comprising a nucleic acid molecule according to the invention.

Also encompassed by the present invention are host cells that comprise a nucleic acid molecule or a vector according to the invention.

The invention is also directed to a recombinant peptide or protein encoded by a nucleic acid molecule according to the invention. The recombinant peptide or protein may consists of an amino acid sequence selected from the group consisting of SEQ ID Nos. 46, 68, 73, 76, 81, 86, 91, 95, 100, 105, 113, 117, 122, 127, 132, 137, 142, 147-150, 222, 229, 236, 241, 246, 251, 256, 261, 266, 271, 276, 281, 286, 291, 296, 301, 306, 316, and 333-336.

In another aspect, the invention is directed to a method for expression of a recombinant peptide or protein, wherein the method comprises (a) introducing a nucleic acid molecule or a vector of the invention, wherein the nucleic acid molecule or vector encodes the recombinant peptide or protein, into a suitable host cell; and (b) cultivating the host cell in a culture medium under conditions that allow expression of the recombinant peptide or protein.

The method may, in various embodiments, further comprise recovering the expressed peptide or protein from the host cell and/or the culture medium. In preferred embodiments of the methods described herein, the method further comprises secretion of the expressed recombinant peptide or protein into the culture medium by cultivating the host cell under conditions that allow secretion of the recombinant peptide or protein into the culture medium. To achieve this, the host cell may comprise further nucleic acid molecules that encode for components of a secretion system.

In various embodiments of the methods of the invention, (a) the host cell is a prokaryotic cell, for example an *E. coli* cell; and/or (b) the host cell expresses HlyB and HlyD, for example either endogenously or by introduction of exogenous nucleic acid sequences; and/or (c) the expression is performed in minimal culture medium; and/or (d) the culture medium comprises 1-40 mM of $Ca^{2+}$; and/or (e) the expressed recombinant peptide or protein is the recombinant peptide or protein according to the invention; and/or (f) the recombinant peptide or protein is purified using a method selected from affinity chromatography, ion exchange chromatography, reverse phase chromatography, size exclusion chromatography, and combinations thereof; and/or (g) the method comprises treatment of the recombinant peptide or protein with a protease suitable for cleavage of a protease cleavage site within the recombinant peptide or protein; and/or (h) the method comprises a step as defined in (g) followed by purification of the recombinant peptide or protein.

In still another aspect, the present invention also relates to the use of a nucleic acid molecule of the invention or a vector according to the invention for the expression of a recombinant peptide or protein. In a further aspect, the present invention relates to an isolated nucleic acid molecule comprising, consisting essentially of or consisting of a first nucleic acid sequence encoding a fragment of hemolysin A and having the nucleotide sequence as set forth in SEQ ID NO:34 or the complement thereof or a nucleotide sequence that has at least 70% sequence identity with the nucleotide sequence set forth in SEQ ID NO:34 or the complement thereof or a nucleotide sequence encoding the polypeptide with the amino acid sequence set forth in SEQ ID NO:46. The isolated nucleic acid molecule does not include the nucleotide sequence encoding for full length hemolysin A, for example does not include the full nucleotide sequence set forth in SEQ ID NO:29.

The isolated nucleic acid molecule may comprise a first and a second nucleic acid sequence, wherein the first nucleic acid sequence is defined as above, i.e. having the nucleotide sequence as set forth in SEQ ID NO:34 or the complement thereof, and the second nucleic acid sequence encodes for at least one peptide or protein of interest and is operably linked to the 3" or 5" end of the first nucleic acid sequence.

In various embodiments of this aspect, the isolated nucleic acid molecule further comprises at least one third nucleic acid sequence encoding for an affinity tag and/or a protease cleavage site, wherein the at least one third nucleic acid sequence is operably linked to the 5" and/or 3" end of the first nucleic acid molecule and/or the second nucleic acid molecule.

In specific embodiments, the isolated nucleic acid molecule has the nucleotide sequence as set forth in any one of SEQ ID Nos. 67, 72, 75, 80, 85, 90, 94, 99, 104, 111, 116, 121, 126, 131, 136, 141, 146, 221, 228, 235, 240, 245, 250, 255, 260, 265, 270, 275, 280, 285, 290, 295, 300, 305, 315, 326, 328, 330, and 332.

The nucleic acid molecules according to this aspect can also be comprised in a vector, as disclosed in connection with the nucleic acid molecules of the first aspect above. Similarly, host cells that include this vector or nucleic acid molecule are also encompassed by the present invention and can also be defined as given above.

In a still further aspect, the invention also relates to the recombinant peptide or protein encoded by a nucleic acid molecule according to the above detailed aspect. The recombinant peptide or protein may comprise or consists of an amino acid sequence selected from the group consisting of SEQ ID Nos. 46, 68, 73, 76, 81, 86, 91, 95, 100, 105, 113, 117, 122, 127, 132, 137, 142, 147-150, 222, 229, 236, 241, 246, 251, 256, 261, 266, 271, 276, 281, 286, 291, 296, 301, 306, 316, and 333-336.

In another aspect, the present invention is directed to a method for expression of a recombinant peptide or protein, wherein the method comprises (a) introducing a nucleic acid molecule or a vector according to the invention, wherein the nucleic acid molecule or vector encodes the recombinant peptide or protein, into a suitable host cell; and (b) cultivating the host cell in a culture medium under conditions that allow expression of the recombinant peptide or protein and secretion of the recombinant peptide or protein into the culture medium. In various embodiments, the method further comprises recovering the expressed peptide or protein from the host cell and/or the culture medium. As already detailed above, in these methods, the host cell may be a prokaryotic cell; and/or the host cell may express HlyB and HlyD; and/or the expression may be performed in minimal culture medium; and/or the culture medium may comprise 1-40 mM of $Ca^{2+}$; and/or the expressed recombinant peptide or protein may be the recombinant peptide or protein according to the invention; and/or the recombinant peptide or protein may be purified using a method selected from affinity chromatography, ion exchange chromatography, reverse phase chromatography, size exclusion chromatography, and combinations thereof; and/or the method may comprise treatment of the recombinant peptide or protein with a protease suitable for cleavage of a protease cleavage site within the recombinant peptide or protein; and/or the method may comprise a step as defined in (g) followed by purification of the recombinant peptide or protein.

The use of a nucleic acid molecule or vector according to the above aspect of the invention for the expression of a recombinant peptide or protein is also contemplated herein.

It is understood that all combinations of the above disclosed embodiments are also intended to fall within the scope of the present invention.

DETAILED DESCRIPTION OF THE INVENTION

Figure 1:
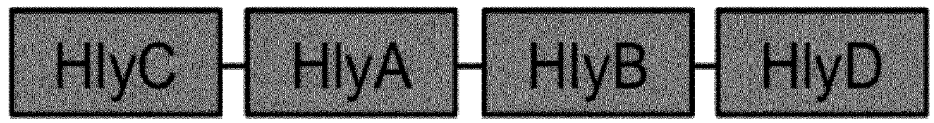
FIG. 1 shows the native organization of the genes in the hemolysin operon.

The terms used herein have, unless explicitly stated otherwise, the following meanings.

"At least one", as used herein, relates to one or more, in particular 1, 2, 3, 4, 5, 6, 7, 8, 9, 10 or more. "Isolated" as used herein in relation to a molecule means that said molecule has been at least partially separated from other molecules it naturally associates with or other cellular components. "Isolated" may mean that the molecule has been purified to separate it from other molecules and components, such as other proteins and nucleic acids and cellular debris.

"Nucleic acid" as used herein includes all natural forms of nucleic acids, such as DNA and RNA. Preferably, the nucleic acid molecules of the invention are DNA.

The term "3" fragment", as used herein in relation to a nucleic acid molecule, relates to a nucleic acid sequence which is compared to its reference nucleic acid sequence shorter in that it lacks one or more 5"terminal nucleotides. A 3" fragment of SEQ ID NO:1, as described herein comprises at least the 3" nucleotides of the sequence set forth in SEQ ID NO:2, or SEQ ID NO:3, or SEQ ID NO:4, or SEQ ID NO:5.

The term "5" fragment", as used herein in connection with a nucleic acid molecule, relates to a nucleic acid sequence which is compared to its reference nucleic acid sequence shortened by one or more 3" terminal nucleotides. The shortening occurs starting from the 3" end such that a contiguous strand of nucleotides starting from the 5" end remains. The fragment has preferably a length of at least 20, more preferably at least 50 nucleotides.

The term "peptide" is used throughout the specification to designate a polymer of amino acid residues connected to each other by peptide bonds. A peptide according to the present invention has 2-100 amino acid residues.

The terms "protein" and "polypeptide" are used interchangeably throughout the specification to designate a polymer of amino acid residues connected to each other by peptide bonds. A protein or polypeptide according to the present invention has preferably 100 or more amino acid residues.

The term "an N-terminal fragment" relates to a peptide or protein sequence which is in comparison to a reference peptide or protein sequence C-terminally truncated, such that a contiguous amino acid polymer starting from the N-terminus of the peptide or protein remains. In some embodiments, such fragments may have a length of at least 10 amino acids.

The term "a C-terminal fragment" relates to a peptide or protein sequence which is in comparison to a reference peptide or protein sequence N-terminally truncated, such that a contiguous amino acid polymer starting from the C-terminus of the peptide or protein remains. In some embodiments, such fragments may have a length of at least 10 amino acids.

The term "fusion protein" as used herein concerns peptides and proteins which are N- or C-terminally connected to each other. Such fusion proteins may be encoded by nucleic acid sequences which are operably fused to each other. In certain embodiments, a fusion protein refers to at least one peptide or protein of interest C-terminally fused to a polypeptide chain according to the invention, for example a polypeptide chain comprising HlyA or a fragment thereof or a homolog thereof.

Generally, the skilled person understands that for putting the present invention into practice any nucleotide sequence described herein may or must comprise an additional start and/or stop codon or that a start and/or stop codon of any of the sequences described herein may or must be deleted depending on the nucleic acid construct used. The skilled person will base this decision, e.g., on whether a nucleic acid sequence comprised in the nucleic acid molecule of the present invention is to be translated and/or is to be translated as a fusion protein.

The hemolysin (Hly) secretion system is a protein secretion system which mostly occurs in gram-negative bacteria. This secretion system belongs to the family of type I secretion systems which transport their substrates in an ATP driven manner in a single step from the cytosol to the extracellular space without an intermediate station in the periplasm. The Hly secretion system comprises hemolysin B (HlyB) which represents an ATP-binding cassette (ABC) transporter, the membrane fusion protein hemolysin D (HlyD), and the universal outer membrane protein TolC. The ~110 kDa hemolytic toxin hemolysin A (HlyA) is a transport substrate of the Hly secretion system. On genetic level, the components necessary for hemolysin A-specific secretion are organized in an operon structure (cf. FIG. 1). The nucleic acid sequence encoding for hemolysin C (HlyC) also forms part of this operon but is not required for HlyA secretion through the Hly secretion system. HlyC catalyzes acylation of HlyA which renders HlyA hemolytic. HlyA is a protein which consists of 1024 amino acid residues and requires for its export via the Hly secretion system its C-terminus comprising about 40-60 amino acids. Furthermore, HlyA is characterized in that it comprises N-terminally to the 50 C-terminal amino acids a domain comprising several glycine rich (GG) repeats (GGXGXDXXX, wherein X can be any amino acid). Glycine rich repeats are the characteristic of the repeats in toxin (RTX) toxin family. The glycine rich repeats bind $Ca^{2+}$ which induces their folding. Hence, in absence of $Ca^{2+}$ the domain comprising the glycine rich repeats is unstructured. The amino acid sequence of one HlyA protein is set forth in SEQ ID NO:41, as encoded by the nucleotide sequence set forth in SEQ ID NO:29). One exemplary nucleotide sequence encoding for HlyC is set forth in SEQ ID NO:158.

The present invention is based on the inventors' surprising finding that the presence of the nucleic acid sequence consisting of the nucleic acid sequence encoding for a fragment of HlyC of the hemolysin operon and the gap sequence located between the sequences encoding for HlyC and HlyA in the hemolysin operon (cf. FIG. 1), wherein the nucleic acid sequence has the sequence as set forth in SEQ ID NO:1 or a 3" terminal fragment thereof, wherein said fragment comprises SEQ ID NO:2, or the complement thereof or a homolog thereof, 5" to a nucleic acid sequence encoding for a peptide or protein of interest can improve the expression and secretion yields of said peptide or protein of interest.

Thus, in a first aspect, the present invention relates to an isolated nucleic acid molecule comprising, consisting essentially of or consisting of a first nucleic acid sequence, wherein the first nucleic acid sequence comprises the nucleotide sequence as set forth in SEQ ID NO:1 or a 3" fragment thereof, wherein the fragment comprises at least the nucleotide sequence as set forth in SEQ ID NO:2, or the complement thereof. The isolated nucleic acid according to the first aspect can increase the expression and secretion of other peptides or proteins if located upstream, i.e. 5", to the sequence encoding said peptides or proteins. In various embodiments, said first nucleic acid sequence comprises a fragment of the nucleotide sequence encoding for hemolysin C (HlyC). The term "fragment of the nucleotide sequence encoding for hemolysin C" as used herein means that the isolated nucleic acid molecule does not comprise a full length sequence encoding hemolysin C but only 3" fragments thereof. In particular, the isolated nucleic acid molecules of the invention do not include a full length sequence encoding for HlyC, as for example set forth in SEQ ID NO:158 or the complement thereof. In various embodiments, the fragments of the sequence encoding HlyC are not expressed in that they are not transcribed and/or translated into a protein sequence but only exert their effects on the nucleic acid level. The minimum fragment comprised by the nucleic acid molecules of the invention is the nucleotide sequence of SEQ ID NO:2, which is the gap sequence between the genes encoding for HlyC and HlyA. The nucleic acid molecules of the invention thus may include fragments of the HlyC gene with the proviso that the full length HlyC gene is excluded.

In various embodiments, this aspect of the invention also includes homologs of the afore-mentioned sequence. The term "homologous" or "homolog" as used herein refers to a polynucleotide or polypeptide sequence that has a highly similar sequence to or high sequence identity (e.g. 70%, 80%, 90%, 95%, 97.5%, 99% or more) with another polynucleotide or polypeptide sequence or part thereof. With regard to the isolated nucleic acid molecule of the invention, the term homologs thus includes nucleic acid sequences that have at least 70, preferably 80, more preferably 90, even more preferably 95, 97.5 or 99% sequence identity to the nucleotide sequence of the first nucleic acid sequence as defined above. The sequence identity may occur over a continuous stretch of nucleotides or may be discontinuous.

The term "sequence identity", as used herein, means that the residue at a given position is identical to that at a corresponding position of a reference nucleic acid.

The term "complement", as used herein, relates to nucleotide sequences that can hybridize to a reference sequence by forming Watson-Crick base pairing. This includes "full complements" wherein each nucleotide of a given sequence Watson-Crick base pairs with a corresponding nucleotide in the reference sequence or each nucleotide of a reference sequence base pairs with a nucleotide in a given sequence.

In various embodiments of the first aspect of the invention, in the isolated nucleic acid molecule the first nucleic acid sequence may have a nucleotide sequence selected from the group consisting of SEQ ID Nos. 2-27 and 3" fragments thereof, wherein the fragments comprise at least the sequence as set forth in SEQ ID NO:2, or the complements thereof. In preferred embodiments, the first nucleic acid sequence comprises or consists of the nucleotide sequences set forth in any one of SEQ ID Nos. 1-27, more preferably SEQ ID Nos. 8-16.

In various embodiments, the 3" fragments of the nucleotide sequences set forth in any one of SEQ ID Nos. 1 and 4-27 comprise at least the nucleotide sequence as set forth in SEQ ID NO:3. In other embodiments, the 3" fragments of the nucleotide sequences set forth in any one of SEQ ID Nos. 1 and 5-27 comprise at least the nucleotide sequence as set forth in SEQ ID NO:4. In still further embodiments, the 3" fragments of the nucleotide sequences set forth in any one of SEQ ID Nos. 1 and 6-27 comprise at least the nucleotide sequence as set forth in SEQ ID NO:5. In still other embodiments, the 3" fragments of the nucleotide sequences set forth in any one of SEQ ID Nos. 1 and 7-26 comprise at least the nucleotide sequence as set forth in SEQ ID NO:6. In another embodiment, the 3" fragments of the nucleotide sequences set forth in any one of SEQ ID Nos. 1 and 8-26 comprise at least the nucleotide sequence as set forth in SEQ ID NO:7.

In one alternative aspect, the 3" fragments of SEQ ID NO:1 as disclosed above comprise at least the nucleotide sequence set forth in SEQ ID NO:28. In one specific embodiment, the 3" fragment may consists of the nucleotide sequence as set forth in SEQ ID NO:28.

The isolated nucleic acid molecule of the invention can, in addition to the first nucleic acid as defined above, comprise a second nucleic acid sequence, wherein said second nucleic acid sequence encodes for at least one peptide or polypeptide of interest. The second nucleic acid sequence is preferably located 3" to the first nucleic acid sequence. Both sequences, i.e. the first and second nucleic acid sequence may be operably linked. In various embodiments, the second nucleic acid sequence encodes for at least 2, 3, 4, 5 or more peptides or proteins of interest. These may be expressed as a fusion or separately. According to this aspect, the second nucleic acid molecule can thus comprise more than one gene encoding for a polypeptide of interest. In one specific embodiment, the second nucleic acid molecule can, for example, encode for a protease and another polypeptide or peptide, where the protease if expressed catalyzes the cleavage of the other polypeptide or peptide out of a fusion construct or the processing of the other polypeptide or peptide.

In some other embodiments, the sequence as set forth in SEQ ID NO:1 or a 3" terminal fragment thereof, or the complement thereof or a homolog thereof is operably linked to the sequence encoding for the peptide or protein of interest in that it can influence its expression, but is not translated. In such an embodiment, the sequence as set forth in SEQ ID NO:1 or a 3" terminal fragment thereof, or the complement thereof or a homolog thereof is not translated or not translated in a single polypeptide chain together with the peptide and protein of interest. Thus, in various embodiments, the sequence as set forth in SEQ ID NO:1 or a 3" terminal fragment thereof, or the complement thereof or a homolog thereof is not translated and the protein composition resulting from the host comprising the nucleic acid molecule will contain the peptide or protein of interest without a fusion partner.

The term "operably linked" in the context of nucleic acid sequences means that a first nucleic acid sequence is linked to a second nucleic acid sequence such that the first nucleic acid sequence is placed in a functional relationship with the second nucleic acid sequence. For instance, a promoter sequence is operably linked to a coding sequence of a heterologous gene if the promoter can initiate the transcription of the coding sequence. In a further context, a sequence encoding for the first peptide or protein, e.g., an affinity tag and/or protease cleavage site, is linked such to a second sequence encoding for a peptide or protein, e.g., a peptide or protein of interest, that if the two sequences are translated a single peptide/protein chain is obtained.

In one embodiment, the first and second nucleic acid sequence are directly linked to each other in that the 3" terminal nucleotide of the first nucleic acid sequence is coupled to the 5" terminal nucleotide of the second nucleic acid. In other embodiments, there is a linker nucleotide sequence present between the first and second nucleic acid sequence.

The term "gap" as used herein refers to the sequence occurring in the hemolysin operon between the HlyC and HlyA cassette as illustrated in FIG. 1. The gap nucleotide sequence is set forth in SEQ ID NO:2.

The first nucleic acid sequence may include non-natural nucleotides or PNA as a replacement for the respective naturally occurring nucleotides. The term "non-natural nucleotides" refers to nucleotides others than those comprising 5"phospho ribose or 5"phospho desoxyribose and adenine, guanine, cytosine, thymine, or uracil. Thus, a non-natural nucleotide may comprise one or more modifications to the sugar moiety and/or base moiety. Also, the phosphodiester backbone of DNA and RNA may be replaced by a different backbone, such as a peptide backbone.

The present invention is further based on the inventors' finding that the use of the above detailed HlyC fragment+ gap sequence of SEQ ID NO:1 is particularly effective for an improved expression of the second nucleic acid sequence encoding for the peptide or protein of interest if the nucleic acid molecule further comprises a third nucleic acid sequence encoding for HlyA or a 3" fragment thereof. Thus, in further embodiments the nucleic acid molecule further comprises a third nucleic acid sequence, the third nucleic acid sequence being either 3" or 5" of the at least one second nucleic acid sequence encoding for a peptide or protein of interest. In another embodiment, the third nucleic acid sequence flanks the second nucleic acid sequence in that the second nucleic acid sequence is inserted into the third nucleic acid sequence. "Inserted", as used in this context, means that a 5" terminal part of the third nucleic acid sequence is located 5" to the second nucleic acid sequence while a 3" terminal part is located 3" to the second nucleic acid sequence. If inserted into the third nucleic acid sequence, the second nucleic acid sequence is preferably placed such that it does not destroy functional regions or domains of the polypeptide encoded by the third nucleic acid sequence, i.e. HlyA.

The third nucleic acid sequence may be operably linked with the second nucleic acid sequence and encodes for hemolysin A (HlyA) or a fragment thereof. In preferred embodiments, they are operably linked such that they are expressed as a single polypeptide chain, i.e. a fusion protein of the peptide or protein of interest and HlyA or a fragment thereof. The HlyA tag may facilitate secretion of the peptide or polypeptide of interest.

In various embodiments, the third nucleic acid sequence has the nucleotide sequence as set forth in SEQ ID NO:29 or a fragment thereof, wherein the fragment comprises at least the nucleotide sequence as set forth in SEQ ID NO:30, or the complement thereof. Also covered are homologs of these sequences, in particular nucleic acid sequences having a nucleotide sequence that has at least 70%, 80%, 90%, 95%, 97.5%, 99 or 99.5% sequence identity to the third nucleic acid sequence as defined above. In further embodiments, such homologs are defined by that they have a nucleotide sequence that encodes for a polypeptide which has at least 91%, preferably at least 95%, more preferably at least 97% sequence homology or identity to the polypeptide encoded by the nucleotide sequence as defined above. In various embodiments, the encoded polypeptide sequence may be identical. Such homologous sequence may for example be codon-optimized version of the reference sequence. "Codon-optimized" means that codons encoding one amino acid residue are replaced by a different codon encoding the same amino acid, but being more frequently used by a given host organism for this particular amino acid. It is understood that such nucleotide sequences that encode a homologous polypeptide may have high sequence variability so that sequence identity between the nucleic acid molecules encoding the same or homologous polypeptides may be low.

In various embodiments, the third nucleic acid sequence has a nucleotide sequence selected from the group consisting of SEQ ID Nos. 30-40, and fragments thereof, wherein the fragments comprise at least the sequence as set forth in SEQ ID NO:30, and the complements thereof. Preferably, the third nucleic acid sequence has the nucleotide sequence set forth in SEQ ID NO:34 or a nucleotide sequence that encodes the amino acid sequence set forth in SEQ ID NO:46.

The isolated nucleic acid molecule of the invention may comprise a combination of first and third nucleic acid sequences as defined above. In various embodiments, the first nucleic acid sequence has a nucleotide sequence selected from the group consisting of SEQ ID Nos. 1-27 or the complements thereof and the third nucleic acid sequence has a nucleotide sequence selected from the group consisting of SEQ ID Nos. 29-40. Preferred combinations are the nucleotide sequences set forth in SEQ ID Nos. 8-16 and the nucleotide sequence of SEQ ID NO:34.

In various embodiments, the architecture of the nucleic acid molecule is (in 5" to 3" orientation): A-B, A-C, A-B-C or A-C-B, wherein A is the first, B is the second and C is the third nucleic acid sequence as defined above. Also contemplated are nucleic acid constructs where the second nucleic acid sequence is missing and the construct only comprises the first and third nucleic acid sequence, for example in the form A-C. The second nucleic acid sequence B can encode for more than one polypeptide or peptide and may have the form D-E-F-G-H- . . . , where each of D, E, F, G, and H can be present or absent and represents a sequence encoding for a different polypeptide or peptide.

In various embodiments, the nucleic acid molecule is constructed such that the protein encoded by the third nucleic acid sequence is not translated or separately translated from the peptide or protein encoded by the second nucleic acid sequence.

In certain embodiments, the peptides or proteins encoded by the second and the third nucleic acid sequences are co-translated leading to a single polypeptide chain, i.e. a fusion protein.

The inventors have further found that the resulting fusion proteins comprising the protein encoded by the third nucleic acid sequence, e.g., HlyA or C-terminal fragments thereof, fused to the C-terminus of the peptide or protein of interest are more efficiently secreted to the extracellular space compared to other secretion systems. Hence, the combination of the first and the third nucleic acid sequence with the second nucleic acid sequence encoding for the peptide or protein of interest allows for an improved expression and secretion of the desired peptide or protein of interest. This approach is particularly suitable in organisms comprising a type 1 secretion system (T1SS), in particular host cells expressing TolC, HlyB, and HlyD. The use of the type 1 secretion system ensures that the peptide or protein is directly secreted to the extracellular space without an intermediate step in the periplasm and avoids the exposure of the expressed peptide or protein to proteases.

The definition that "the third nucleic acid sequence has the nucleotide sequence as set forth in SEQ ID NO:29 or a fragment thereof, wherein the fragment comprises at least the nucleotide sequence as set forth in SEQ ID NO:30" means that the nucleotide sequence comprises at least the nucleotide sequence encoding for amino acids 975-1016 of HlyA (based on the HlyA amino acid sequence as set forth in SEQ ID NO:41), wherein HlyA is encoded by the nucleic acid sequence as set forth in SEQ ID NO:29. In some embodiments, the fragments are 3" fragments of the sequence as set forth in SEQ ID NO:2 and thus comprise at least the sequence as set forth in SEQ ID NO:3 plus the nucleotides encoding the last 8 C-terminal amino acid residues of HlyA (aa 1017-1024). In some embodiments, the third nucleic acid sequence has a sequence selected from the group consisting of SEQ ID Nos. 31-40 or fragments thereof. In various embodiments, the fragments of the nucleotide sequences of SEQ ID Nos. 29 and 31-38 comprise at least the nucleotide sequence of SEQ ID NO: 39 or 40. In other embodiments, the fragments of the nucleotide sequences set forth in SEQ ID Nos. 29 and 31-37 comprise at least the nucleotide sequence set forth in SEQ ID NO:38. In still further embodiments, the fragments of the nucleotide sequences set forth in SEQ ID Nos. 29 and 31-33 comprise at least the nucleotide sequence set forth in SEQ ID NO:34, 35, 36 or 37. In still other embodiments, the third nucleic acid sequence has a sequence corresponding to a sequence selected from the group consisting of SEQ ID Nos:29 and 31-39 lacking the 24 most 3" terminal nucleotides. Thus, these sequences encode for HlyA fragments lacking the 8 most C-terminal amino acid residues.

In certain embodiments, the nucleic acid molecule is further characterized in that the nucleic acid molecule further comprises at least one fourth nucleic acid sequence encoding for an affinity tag and/or a protease cleavage site, wherein the at least one fourth nucleic acid sequence is operably linked to the 5" and/or 3" end of the at least one second nucleic acid molecule and/or the third nucleic acid molecule.

The nucleotide sequence encoding the protease cleavage site may be operably linked to the second nucleic acid molecule and the third nucleic acid molecule such that it is located between second and third nucleic acid sequence. In embodiments, where the second nucleic acid sequence is inserted into the third nucleic acid sequence, the sequence encoding the protease cleavage site can be at either end of the second nucleic acid linked to a part of the third nucleic acid sequence or both ends can comprise a sequence encoding a protease cleavage site.

The term "affinity tag" as used herein relates to entities which are coupled to a molecule of interest and allow enrichment of the complex between the molecule of interest and the affinity tag using an affinity tag receptor. In certain embodiments affinity tags may be selected from the group consisting of the Strep-tag® or Strep-tag® II, the myc-tag, the FLAG-tag, the His-tag, the small ubiquitin-like modifier (SUMO) tag, the covalent yet dissociable NorpD peptide (CYD) tag, the heavy chain of protein C (HPC) tag, the calmodulin binding peptide (CBP) tag, or the HA-tag or proteins such as Streptavidin binding protein (SBP), maltose binding protein (MBP), and glutathione-S-transferase. The term "protease cleavage site" refers to peptide sequence which can be cleaved by a selected protease thus allowing the separation of peptide or protein sequences which are interconnected by a protease cleavage site. In certain embodiments the protease cleavage site is selected from the group consisting of a Factor Xa-, a tobacco edge virus (TEV) protease-, a enterokinase-, a SUMO Express protease-, an Arg-C proteinase-, an Asp-N endopeptidases-, an Asp-N endopeptidase+N-terminal Glu-, a caspase1-, a caspase2-, a caspase3-, a caspase4, a caspase5, a caspase6, a caspase7, a caspase8, a caspase9, a caspase10, a chymotrypsin-high specificity, a chymotrypsin-low specificity-, a clostripain (Clostridiopeptidase B)-, a glutamyl endopeptidase-, a granzymeB-, a pepsin-, a proline-endopeptidase-, a proteinase K-, a staphylococcal peptidase I-, a Thrombin-, a Trypsin-, and a Thermolysin-cleavage site.

In certain embodiments, the nucleic acid molecule is constructed such that the first nucleic acid sequence is not translated. In some embodiments, the nucleic acid molecule is constructed such that the second nucleic acid sequence is translated into an individual peptide or protein. In further embodiments, the nucleic acid molecule comprises at least the first, second and third nucleic acid sequences as defined above and is constructed such that the second nucleic acid sequence is translated into an individual peptide or protein. In various embodiments, the nucleic acid molecule comprises at least the first, second and third nucleic acid sequences as defined above and is constructed such that the second and third nucleic acid sequences are translated to a fusion peptide or protein. The nucleic acid molecule may be constructed such that the translated the peptide or protein encoded by the second nucleic acid sequence and the peptide or protein encoded by the third nucleic acid sequence are fused. "Fused", as used in this context, means that the resulting peptides or proteins are directly connected to each other or linked to each other by one or more amino acids, peptides or proteins, e.g., one or more protease cleavage sites and/or affinity tags.

In some embodiments, the nucleic acid molecule comprises at least the first, second and third nucleic acid sequences as defined above and is constructed such that the second nucleic acid sequence is translated into an individual peptide or protein.

In some embodiments the at least one peptide or protein of interest encoded by the at least one second nucleic acid sequence is a type 1 secretion system substrate, as described below, and the nucleic acid molecule may not require the presence of a third nucleic acid sequence for expression and secretion of the peptide or protein of interest. The type 1 secretion system substrate may induce its export by itself. The term "a peptide or protein of interest" as disclosed herein covers any naturally or non-naturally occurring peptide or protein. In some embodiments, the peptide or protein of interest is a non-natural/synthetic peptide or protein. Synthetic in this connection means that the sequence of the peptide or protein has been artificially designed. Thus, a sequence encoding for a peptide or protein of interest may comprise a nucleic acid sequence encoding for one, two or more naturally occurring peptides or proteins. These naturally occurring peptides or proteins may have been further modified, e.g., by mutagenesis of the encoding sequence.

If the peptide or protein of interest comprises two or more naturally occurring peptides or proteins, the two or more peptides or proteins may be separated by protease cleavage sites.

Generally, any peptide or protein may be chosen as protein of interest. In certain embodiments, the protein of interest is a protein which does not form a homo-dimer or homo-multimer. The avoidance of self interacting peptides or proteins may be advantageous if the recombinant peptide or protein is to be secreted into the cell culture supernatant, because the formation of larger protein complexes may disturb an efficient protein export. However, the protein of interest may also be a peptide or protein which is a subunit of a larger peptide or protein complex. Such a peptide or protein may be isolated after expression and optionally secretion and be suitable for an in vitro reconstitution of the multi peptide or protein complex. In certain embodiments, the protein or peptide of interest is a peptide having less than 100 amino acid residues. If these peptides comprise pre- and/or pro-sequences in their native state after translation the nucleic acid sequence encoding for the peptide of interest may be engineered to be limited to the sequence encoding the mature peptide. One exemplary peptide is insulin, e.g., human insulin. The secretion of over-expressed peptides and proteins is especially advantageous where the peptide or protein is harmful to the host cell. For this reason, the present invention is particularly advantageous for expression of lipases and proteases which are known to be toxic to the host cell and thus the expression of these proteins by the inventive systems and methods represents a specific embodiment of the present invention.

In various embodiments, the peptide or protein of interest is an enzyme.

The International Union of Biochemistry and Molecular Biology has developed a nomenclature for enzymes, the EC numbers; each enzyme is described by a sequence of four numbers preceded by "EC". The first number broadly classifies the enzyme based on its mechanism.

The complete nomenclature can be browsed at http://www.chem.qmul.ac.uk/iubmb/enzyme/.

Accordingly, a peptide or protein of interest according to the present invention may be chosen from any of the classes EC 1 (Oxidoreductases), EC 2 (Transferases), EC 3 (Hydrolases), EC 4 (Lyases), EC 5 (Isomerases), and EC 6 (Ligases), and the subclasses thereof.

In certain embodiments, the peptide or protein of interest is cofactor dependent or harbors a prosthetic group. For expression of such peptides or proteins, in some embodiments, the corresponding cofactor or prosthetic group may be added to the culture medium during expression.

In certain cases, the peptide or protein of interest is a dehydrogenase or an oxidase.

In case the peptide or protein of interest is a dehydrogenase, in some embodiments, the peptide or protein of interest is chosen from the group consisting of alcohol dehydrogenases, glutamate dehydrogenases, lactate dehyrogenases, cellobiose dehydrogenases, formate dehydrogenases, and aldehydes dehydrogenases.

In case the peptide or protein of interest is an oxidase, in some embodiments, the peptide or protein of interest is chosen from the group consisting of cytochrome P450 oxidoreductases, in particular P450 BM3 and mutants thereof, peroxidases, monooxygenases, hydrogenases, monoamine oxidases, aldehydes oxidases, xanthin oxidases, amino acid oxidases, and NADH oxidases.

In further embodiments, the peptide or protein of interest is a transaminase or a kinase.

In case the peptide or protein of interest is a transaminase, in some embodiments, the peptide or protein of interest is chosen from the group consisting of alanine aminotransferases, aspartate aminotransferases, glutamate-oxaloacetic transaminases, histidinol-phosphate transaminases, and histidinol-pyruvate transaminases.

In various embodiments, if the peptide or protein of interest is a kinase, the peptide or protein of interest is chosen from the group consisting of nucleoside diphosphate kinases, nucleoside monophosphate kinases, pyruvate kinase, and glucokinases.

In some embodiments, if the peptide or protein of interest is a hydrolase, the peptide or protein of interest is chosen from the group consisting of lipases, amylases, proteases, cellulases, nitrile hydrolases, halogenases, phospholipases, and esterases.

In certain embodiments, if the peptide or protein of interest is a lyase, the peptide or protein of interest is chosen from the group consisting of aldolases, e.g., hydroxynitrile lyases, thiamine-dependent enzymes, e.g., benzaldehyde lyases, and pyruvate decarboxylases.

In various embodiments, if the peptide or protein of interest is an isomerase, the peptide or protein of interest is chosen from the group consisting of isomerases and mutases.

In some embodiments, if the peptide or protein of interest is a ligase, the peptide or protein of interest may be a DNA ligase.

In certain embodiments, the peptide or protein of interest may be an antibody. This may include a complete immunoglobulin or fragment thereof, which immunoglobulins include the various classes and isotypes, such as IgA, IgD, IgE, IgG1, IgG2a, IgG2b and IgG3, IgM, etc. Fragments thereof may include Fab, Fv and F(ab')2, Fab', and the like.

Also contemplated herein are therapeutically active peptides and proteins of interest, e.g., a cytokine.

Thus, in certain embodiments the peptide or protein of interest is selected from the group consisting cytokines, in particular human or murine interferons, interleukins, colony-stimulating factors, necrosis factors, e.g., tumor necrosis factor, and growth factors.

In some embodiments, if the peptide or protein of interest is an interferon, the peptide or protein of interest may be selected from the group consisting of interferon alpha, e.g., alpha-1, alpha-2, alpha-2a, and alpha-2b, alpha-2, alpha-16, alpha 21, beta, e.g., beta-1, beta-1a, and beta-1b, or gamma.

In further embodiments, the peptide or protein of interest is an antimicrobial peptide, in particular a peptide selected from the group consisting of bacteriocines and lantibiotics, e.g., nisin, cathelicidins, defensins, and saposins.

Also disclosed herein are peptides or proteins of interest which are therapeutically active peptides or proteins. In certain embodiments, the peptide or protein of interest is a therapeutically active peptide. In some embodiments, a therapeutically active peptide may be selected from the group consisting of Fuzeon/T20, human calcitonin, salmon calcitonin, human corticotropin release factor, Mab40, Mab42, peptides associated with Alzheimer's disease, and exenatide.

In certain embodiments, the peptide or protein of interest is a type I secretion substrate. More than 1000 proteins are annotated or have been described as type I secretion substrates in the literature. Many of them have interesting characteristics for the biotechnological usage, in particular proteases and lipases. Suitable proteases and lipases have been described by Baumann et al. (1993) EMBO J 12, 3357-3364; and Meier et al. (2007) J. BIOL. CHEM.: 282(43), pp. 31477-31483. The content of each of these documents is incorporated by reference herein in its entirety.

Of course, as already mentioned above, the at least one nucleic acid sequence encoding for the peptide or protein of interest may be subjected to mutagenesis and thus lead to a mutated peptide or protein of interest on protein level.

The term "mutation" as used herein relates to a variation in the nucleotide and/or amino acid sequence of a given nucleotide sequence or protein and includes substitutions, deletions, truncations, and insertions. In one specific example, the mutation is a point mutation, i.e. the replacement of one or more nucleotides and/or amino acids in a given sequence. It is understood that if the term "mutation" is used in relation to a protein sequence, that the nucleotide sequence encoding the protein can comprise multiple mutations or modifications, including silent mutations that, for example, serve the purpose to increase expression efficiency (codon-optimization) without changing the amino acid sequence. In the present invention, the mutation is preferably the substitution of one or two amino acids by other amino acids. Alternatively or in addition, the nucleic acid molecule may comprise nucleotide exchanges which do not alter the encoded protein sequence, so called silent mutations. In some embodiments, the mutations, e.g., silent mutations increase the expression and/or secretion efficiency of the peptide or protein encoded by the nucleic acid molecule. Importantly, mutations may be induced throughout the nucleic acid molecule of the present invention. Thus, the mutations may not be limited to sequences encoding for a peptide or protein. Accordingly, also non-coding sequence stretches may be subjected to mutagenesis. This type of mutation also falls within the scope of the term silent mutation. The mutagenesis of non-coding sequences may be advantageous, e.g., for the achievement of an improved expression and/or secretion of a peptide or protein encoded by a different sequence stretch within the nucleic acid molecule.

The term "mutagenesis" as used herein means that the experimental conditions are chosen such that the amino acid naturally occurring at a given sequence position of a protein sequence can be substituted by at least one amino acid that is not present at this specific position in the respective natural polypeptide sequence. The term "mutagenesis" also includes the (additional) modification of the length of sequence segments by deletion or insertion of one or more amino acids. Thus, it is within the scope of the invention that, for example, one amino acid at a chosen sequence position is replaced by a stretch of three random mutations, leading to an insertion of two amino acid residues compared to the length of the respective segment of the wild type protein. Such an insertion or deletion may be introduced independently from each other in any of the peptide segments that can be subjected to mutagenesis in the invention.

The term "random mutagenesis" means that no predetermined single amino acid (mutation) is present at a certain sequence position but that one of at least two different amino acids can be incorporated with a certain probability at a predefined sequence position during mutagenesis.

The natural coding sequence of a protein sequence, i.e. the respective gene segment of an enzyme, can be used as a starting point for the mutagenesis of the amino acid positions selected in the present invention. For the mutagenesis of the recited amino acid positions, the person skilled in the art has at his disposal the various established standard methods for site-directed mutagenesis (Sambrook, J. et al. (2001) Molecular Cloning: A Laboratory Manual, 3rd Ed., Cold Spring Harbor Laboratory Press, Cold Spring Harbor, N.Y.). A commonly used technique is the introduction of mutations by means of PCR (polymerase chain reaction) using mixtures of synthetic oligonucleotides, which bear a degenerate base composition at the desired sequence positions. For example, use of the codon NNK or NNS (wherein N=adenine, guanine, cytosine or thymine; K=guanine or thymine; S=adenine or cytosine) allows incorporation of all 20 amino acids plus the amber stop codon during mutagenesis, whereas the codon VVS limits the number of possibly incorporated amino acids to 12, since it excludes the amino acids Cys, Ile, Leu, Met, Phe, Trp, Tyr, Val from being incorporated into the selected position of the polypeptide sequence (V=adenine, guanine, or cytosine); use of the codon NMS (wherein M=adenine or cytosine), for example, restricts the number of possible amino acids to 11 at a selected sequence position since it excludes the amino acids Arg, Cys, Gly, Ile, Leu, Met, Phe, Trp, Val from being incorporated at a selected sequence position. Another possibility is the use of codons NDT or NDC (wherein D=adenine, guanine, or thymine) as this provides a 1:1 ratio between the number of codons and the encoded amino acids, thus reduces the screening effort, and leads to a balanced set of 12 polar, non-polar, aromatic, non-aromatic, hydrophilic and hydrophobic amino acid residues (Arg, Asn, Asp, Cys, Gly, His, Ile, Leu, Phe, Ser, Tyr, Val (Reetz M T et al., 2008, ChemBioChem, 21; 9(11):1797-804)).

In this respect it is noted that codons for other amino acids (than the regular 20 naturally occurring amino acids) such as selenocysteine or pyrrolysine can also be incorporated into a nucleic acid molecule of the present invention. It is also possible, as described by Wang, L. et al ((2001) Science 292, 498-500) or Wang, L., and Schultz, P. G. ((2002) Chem. Comm. 1, 1-11) to use "artificial" codons such as UAG which are usually recognized as stop codons in order to insert other unusual amino acids, for example o-methyl-L-tyrosine or p-aminophenylalanine.

The use of nucleotide building blocks with reduced base pair specificity, as for example inosine, 8-oxo-2"deoxyguanosine or 6(2-deoxy-β-D-ribofuranosyl)-3,4-dihydro-8H-pyrimidino-1,2-oxazine-7-one (Zaccolo et al. (1996) J. Mol. Biol. 255, 589-603), is another option for the introduction of mutations into a chosen sequence segment.

A further possibility is the so-called triplet-mutagenesis. This method uses mixtures of different nucleotide triplets, each of which codes for one amino acid, for incorporation into the coding sequence (Virnekäs B, Ge L, Plückthun A, Schneider K C, Wellnhofer G, Moroney S E. (1994). Nucleic Acids Res 22, 5600-5607).

One possible strategy for introducing mutations in the selected positions is based on the use of two oligonucleotides, each of which is partially derived from one of the corresponding sequence stretches wherein the amino acid position to be mutated is located. When synthesizing these oligonucleotides, a person skilled in the art can employ mixtures of nucleic acid building blocks for the synthesis of those nucleotide triplets which correspond to the amino acid positions to be mutated so that codons encoding all natural amino acids randomly arise, which at last results in the generation of a protein library. A multitude of established procedures are available for ligation and cloning (Sambrook, J. et al. (2001), supra). For example, recognition sequences for restriction endonucleases also present in the sequence of the cloning vector can be engineered into the sequence of the synthetic oligonucleotides. Thus, after amplification of the respective PCR product and enzymatic cleavage the resulting fragment can be easily cloned using the corresponding recognition sequences.

Longer sequence segments within the gene coding for the peptide or protein selected for mutagenesis can also be subjected to random mutagenesis via known methods, for example by use of the polymerase chain reaction under conditions of increased error rate, by chemical mutagenesis or by using bacterial mutator strains. Such methods can also be used for further optimization of the target affinity or specificity of a polymerase mutein. Mutations possibly occurring outside the segments of experimental mutagenesis are often tolerated or can even prove to be advantageous, for example if they contribute to an improved folding efficiency or folding stability of the mutated peptide or protein. Particularly, for long and difficult to amplify nucleic acid sequences the PCR-based mutagenesis protocol provided by Reetz and colleagues (Sanchis J et al., Appl. Microbiol. Biotechnol. 2008 November; 81(2):387-97) may be applied.

As used herein, the term "mutated amino acid residue" means an amino acid residue that differs from the amino acid residue in the same sequence position in the wild-type peptide or protein.

For certain peptides or proteins of interest, the natural gene or cDNA encoding for the peptide or protein comprises a 5"-sequence encoding a secretion signal peptide. In certain embodiments the nucleotide sequence encoding for this peptide is comprised in the DNA encoding for the peptide or protein of interest of the present invention. In other embodiments, this nucleotide sequence has been removed by means of genetic engineering. In further embodiments, this sequence has been replaced by a different sorting/secretion peptide or affinity tag. The choice of the replacement sorting/secretion peptide may depend on the host organism chosen for protein expression, the later purification, or the application of the peptide or protein of interest. In further embodiments, the sequence of the peptide or protein of interest has been N- and/or C-terminally truncated relative to the wildtype enzyme sequence. Accordingly, in certain embodiments the peptide or protein of interest comprises a deletion of at least one N-terminal amino acid relative to the wildtype enzyme sequence. In further embodiments, the peptide or protein of interest comprises a deletion of at least one C-terminal amino acid relative to the wildtype enzyme sequence. In alternative embodiments, the peptide or protein of interest comprises a deletion of at least one N- and/or C-terminal amino acid relative to the wildtype enzyme sequence. In certain embodiments, the peptide or protein of interest comprises a deletion of at least 10, 20, 30, 40, 50, or more N- and/or C-terminal amino acid relative to the wildtype peptide or protein sequence.

In some embodiments, a nucleic acid sequence encoding for a peptide or protein of interest is subjected to mutagenesis in order to modify the folding kinetics of the encoded peptide or protein, in particular to slow down the refolding kinetics of the protein. It has been found by the inventors that in certain cases a mutant with slowed down refolding kinetics is even more efficiently secreted than its native counterpart without affecting the protein stability.

This mutagenesis can be achieved by site-specific mutation based on rational design or a random mutation. One possible approach is the use of error-prone PCR, which results in random point mutations over a selected range of sequence positions of the peptide or protein of interest. The error-prone PCR can be carried out in accordance with any known protocol such as the one described by Zaccolo et al. (1996) J. Mol. Biol. 255, 589-603. Other methods of random mutagenesis which are suitable for such purposes include random insertion/deletion (RID) mutagenesis as described by Murakami, H et al. (2002) Nat. Biotechnol. 20, 76-81 or non-homologous random recombination (NRR), as described by Bittker, J. A. et al. (2002) Nat. Biotechnol. 20, 1024-1029. Rational design may be especially employed, if the crystal structure or NMR structure of the peptide or protein of interest is available. One possibility may be to mutate amino acid residues which induce a rigid folding of the peptide or protein of interest or have in comparison to other amino acid residues a rather fixed position within the 3D structure.

The resulting mutants may be screened for the desired refolding kinetics using spectroscopic techniques, for example CD spectroscopy.

In certain embodiments, the at least one second nucleic acid encodes for a peptide or protein of interest which is chosen from the group consisting of MBP, lipase CalB, protease SprP, hydrolase PlaB, hydrolase PlaK, hydrolase PlbF, lipase TesA, Vif, human interferon alpha-1, alpha-2, alpha-8, alpha-16, alpha-21, human interferon beta, human interferon gamma, murine interferon alpha, murine interferon gamma, IFABP, Cas2, affibody protein ZA3, nisin, corticotropin release factor, amyloid-beta peptide, exenatide, Fuzeon/T20, salmon calcitonin, Mab40, Mab42, lipase LipA, SprP, the HIV-1 protein Vif, and human calcitonin.

In various embodiments of the present invention, the nucleic acid molecule comprises or consists of a nucleic acid sequence as set forth in SEQ ID Nos. 66, 71, 74, 79, 84, 89, 93, 98, 103, 110, 115, 120, 125, 130, 135, 140, 145, 220, 227, 234, 239, 244, 249, 254, 259, 264, 269, 274, 279, 284, 289, 294, 299, 304, 325, 327, 329, and 331 encoding for fusion proteins.

In certain embodiments, the above defined nucleic acid molecules may be comprised in a vector, for example a cloning or expression vector. Generally, the nucleic acid molecules of the invention can also be part of a vector or any other kind of cloning vehicle, including, but not limited to a plasmid, a phagemid, a phage, a baculovirus, a cosmid, or an artificial chromosome.

Generally, a nucleic acid molecule disclosed in this application may be "operably linked" to a regulatory sequence (or regulatory sequences) to allow expression of this nucleic acid molecule.

Such cloning vehicles can include, besides the regulatory sequences described above and a nucleic acid sequence of the present invention, replication and control sequences derived from a species compatible with the host cell that is used for expression as well as selection markers conferring a selectable phenotype on transformed or transfected cells. Large numbers of suitable cloning vectors are known in the art, and are commercially available.

In certain embodiments the nucleic acid molecules disclosed herein are comprised in a cloning vector. In some embodiments the nucleic acid molecules disclosed herein are comprised in an expression vector.

The vectors may comprise regulatory elements for replication and selection markers. In certain embodiments, the selection marker may be selected from the group consisting of genes conferring ampicillin, kanamycin, chloramphenicol, tetracycline, blasticidin, spectinomycin, gentamicin, hygromycin, and zeocin resistance.

An above-described nucleic acid molecule of the present invention, comprising a nucleic acid sequence encoding for a protein of interest, if integrated in a vector, must be integrated such that the peptide or protein of interest can be expressed. Therefore, a vector of the present invention comprises sequence elements which contain information regarding to transcriptional and/or translational regulation, and such sequences are "operably linked" to the nucleotide sequence encoding the polypeptide. An operable linkage in this context is a linkage in which the regulatory sequence elements and the sequence to be expressed are connected in a way that enables gene expression. The precise nature of the regulatory regions necessary for gene expression may vary among species, but in general these regions comprise a promoter which, in prokaryotes, contains both the promoter per se, i.e. DNA elements directing the initiation of transcription, as well as DNA elements which, when transcribed into RNA, will signal the initiation of translation. Such promoter regions normally include 5' non-coding sequences involved in initiation of transcription and translation, such as the −35/−10 boxes and the Shine-Dalgarno element in prokaryotes or the TATA box, CAAT sequences, and 5'-capping elements in eukaryotes. These regions can also include enhancer or repressor elements as well as translated signal and leader sequences for targeting the native polypeptide to a specific compartment of a host cell.

In addition, the 3' non-coding sequences may contain regulatory elements involved in transcriptional termination, polyadenylation or the like. If, however, these termination sequences are not satisfactory functional in a particular host cell, then they may be substituted with signals functional in that cell.

Therefore, a vector comprising a nucleic acid molecule of the invention can comprise a regulatory sequence, preferably a promoter sequence. In certain embodiments, the promoter is identical or homologous to promoter sequences of the host genome. In such cases endogenous polymerases may be capable to transcribe the nucleic acid molecule sequence comprised in the vector. In various embodiments, the promoter is selected from the group of weak, intermediate and strong promoters, preferably from weak to intermediate promoters.

In another preferred embodiment, a vector comprising a nucleic acid molecule of the present invention comprises a promoter sequence and a transcriptional termination sequence. Suitable promoters for prokaryotic expression are, for example, the araBAD promoter, the tet-promoter, the lacUV5 promoter, the CMV promotor, the EF1 alpha promotor, the AOX1 promotor, the tac promotor, the T7 promoter, or the lac promotor. Examples of promoters useful for expression in eukaryotic cells are the SV40 promoter or the CMV promoter. Furthermore, a nucleic acid molecule of the invention can comprise transcriptional regulatory elements, e.g., repressor elements, which allow regulated transcription and translation of coding sequences comprised in the nucleic acid molecule. Repressor element may be selected from the group consisting of the Lac-, AraC-, or MalR-repressor.

The vector may be effective for prokaryotic or eukaryotic protein expression. In particular, the nucleic acid molecules of the present invention may be comprised in a vector for prokaryotic protein expression. In certain embodiments, the vector is pSU-HlyA or pSU-HlyA1 and has a nucleotide sequence as set forth in SEQ ID NO:62 or 63, respectively. Said vector sequences do not yet include the second nucleotide sequence encoding the peptide or protein of interest, but are however constructed such that such a sequence can easily be inserted using techniques well known to those skilled in the art.

In certain embodiments, the vector is selected from the group consisting of a pET-vector, a pBAD-vector, a pK184-vector, a pMONO-vector, a pSELECT-vector, pSELECT-Tag-vector, a pVITRO-vector, a pVIVO-vector, a pORF-vector, a pBLAST-vector, a pUNO-vector, a pDUO-vector, a pZERO-vector, a pDeNy-vector, a pDRIVE-vector, a pDRIVE-SEAP-vector, a HaloTag®Fusion-vector, a pTARGET™-vector, a Flexi®-vector, a pDEST-vector, a pHIL-vector, a pPIC-vector, a pMET-vector, a pPink-vector, a pLP-vector, a pTOPO-vector, a pBud-vector, a pCEP-vector, a pCMV-vector, a pDisplay-vector, a pEF-vector, a pFL-vector, a pFRT-vector, a pFastBac-vector, a pGAPZ-vector, a pIZ/V5-vector, a pLenti6-vector, a pMIB-vector, a pOG-vector, a pOpti-vector, a pREP4-vector, a pRSET-vector, a pSCREEN-vector, a pSecTag-vector, a pTEF1-vector, a pTracer-vector, a pTrc-vector, a pUB6-vector, a pVAX1-vector, a pYC2-vector, a pYES2-vector, a pZeo-vector, a pcDNA-vector, a pFLAG-vector, a pTAC-vector, a pT7-vector, a Gateway®-vector, a pQE-vector, a pLEXY-vector, a pRNA-vector, a pPK-vector, a pUMVC-vector, a pLIVE-vector, a pCRUZ-vector, a Duet-vector, and other vectors or derivatives thereof.

The vectors of the present invention may be chosen from the group consisting of high, medium and low copy vectors.

In certain embodiments, the vector is the pSU vector comprising the nucleic acid molecule of the present invention. In certain embodiments the pSU vector comprises the first nucleic acid sequence and optionally (i) the second nucleic acid sequence and/or (ii) the third nucleic acid sequence and/or (iii) the fourth nucleic acid sequence, with all these sequences being as defined above. Specifically, the pSU vector can comprise any of the specific combinations and architectures of sequences disclosed above.

In some embodiments, the vector is constructed such that the first nucleic acid sequence comprising the HlyC fragment or the homolog thereof is not translated or translated as an individual amino acid sequence.

The above described vectors of the present invention may be used for the transformation or transfection of a host cell in order to achieve expression of a peptide or protein which is encoded by an above described nucleic acid molecule and comprised in the vector DNA. Thus, in a further aspect, the present invention also relates to a host cell comprising a vector or nucleic acid molecule as disclosed herein.

Also contemplated herein are host cells, which comprise a nucleic acid molecule as described herein integrated into their genomes. The skilled person is aware of suitable methods for achieving the nucleic acid molecule integration. For example, the molecule may be delivered into the host cells by means of liposome transfer or viral infection and afterwards the nucleic acid molecule may be integrated into the host genome by means of homologous recombination. In certain embodiments, the nucleic acid molecule is integrated at a site in the host genome, which mediates transcription of the peptide or protein of the invention encoded by the nucleic acid molecule. In various embodiments, the nucleic acid molecule further comprises elements which mediate transcription of the nucleic acid molecule once the molecule is integrated into the host genome and/or which serve as selection markers.

In certain embodiments, the nucleic acid molecule of the present invention is transcribed by a polymerase natively encoded in the host genome. In various embodiments, the nucleic acid molecule is transcribed by a RNA-polymerase which is non-native to the host genome. In such embodiments, the nucleic acid molecule of the present invention may further comprise a sequence encoding for a polymerase and/or the host genome may be engineered or the host cell may be infected to comprise a nucleic acid sequence encoding for an exogenous polymerase.

The host cell may be specifically chosen as a host cell capable of expressing the gene. In addition or otherwise, in order to produce a peptide or protein, a fragment of the peptide or protein or a fusion protein of the peptide or protein with another polypeptide, the nucleic acid coding for the peptide or protein can be genetically engineered for expression in a suitable system. Transformation can be performed using standard techniques (Sambrook, J. et al. (2001), supra).

Prokaryotic or eukaryotic host organisms comprising such a vector for recombinant expression of a peptide or protein of interest as described herein form also part of the present invention. Suitable host cells can be prokaryotic cell. In certain embodiments the host cells are selected from the group consisting of gram positive and gram negative bacteria. In some embodiments, the host cell is a gram negative bacterium, such as *E. coli*. In certain embodiments, the host cell is *E. coli*, in particular *E. coli* BL21 (DE3) or other *E. coli* K12 or *E. coli* B834 derivatives. In further embodiments, the host cell is selected from the group consisting of *Escherichia coli* (*E. coli*), *Pseudomonas, Serratia marcescens, Salmonella, Shigella* (and other enterobacteriaceae), *Neisseria, Hemophilus, Klebsiella, Proteus, Enterobacter, Helicobacter, Acinetobacter, Moraxella, Helicobacter, Stenotrophomonas, Bdellovibrio, Legionella*, acetic acid bacteria, *Bacillus, Bacilli, Carynebacterium, Clostridium, Listeria, Streptococcus, Staphylococcus*, and Archaea cells. Suitable eukaryotic host cells are among others CHO cells, insect cells, fungi, yeast cells, e.g., *Saccharomyces cerevisiae, S. pombe, Pichia pastoris*.

The transformed host cells are cultured under conditions suitable for expression of the nucleotide sequence encoding a peptide or protein of the invention. In certain embodiments, the cells are cultured under conditions suitable for expression and secretion of the nucleotide sequence encoding a peptide or protein of the invention.

For producing the recombinant peptide or protein of interest, a vector of the invention is introduced into a suitable prokaryotic or eukaryotic host organism by means of recombinant DNA technology (as already outlined above). For this purpose, the host cell is first transformed with a vector comprising a nucleic acid molecule according to the present invention using established standard methods (Sambrook, J. et al. (2001), supra). The host cell is then cultured under conditions, which allow expression of the heterologous DNA and thus the synthesis of the corresponding polypeptide. Subsequently, the polypeptide is recovered either from the cell or from the cultivation medium.

Thus, the present invention also relates to a recombinant peptide or protein encoded by a nucleic acid molecule as described herein. These proteins may comprise a peptide or a protein of interest C-terminally fused with HlyA or a fragment thereof. For example, HlyA or the fragments thereof having the peptide sequence as set forth in SEQ ID NOs:41-52 and fragments thereof may be fused to the C-terminus of the protein of interest. These HlyA fusions are particularly advantageous if the protein of interest is to be secreted into the extracellular space. Of course, in certain embodiments the peptide or protein of interest is C-terminally fused to at least one protease cleavage site and/or affinity tag and this entity is C-terminally fused to HlyA or fragments thereof. In some embodiments, the peptide or protein of interest is N-terminally fused to at least one affinity tag and/or protease cleavage site and C-terminally fused to HlyA or fragments thereof. Of course, the peptide or protein of interest may be fused to HlyA or fragments thereof via at least one protease cleavage site and/or affinity tag.

In various embodiments, the recombinant peptide or protein comprises or consists of an amino acid sequence selected from the group consisting of any one of SEQ ID Nos. 46, 68, 73, 76, 81, 86, 91, 95, 100, 105, 113, 117, 122, 127, 132, 137, 142, 147-150, 222, 229, 236, 241, 246, 251, 256, 261, 266, 271, 276, 281, 286, 291, 296, 301, 306, 316, and 333-336.

For expression of the peptides and proteins of the present invention several suitable protocols are known to the skilled person.

The expression of a recombinant peptide or protein of the present invention may be achieved by the following method comprising: (a) introducing a nucleic acid molecule or vector of the invention into a host cell, wherein the nucleic acid molecule or vector encodes the recombinant peptide or protein; and (b) cultivating the host cell in a culture medium under conditions that allow expression of the recombinant peptide or protein.

Step (a) may be carried out by using suitable transformation and transfection techniques known to those skilled in the art. These techniques are usually selected based on the type of host cell into which the nucleic acid is to be introduced. In some embodiments, the transformation may be achieved using electroporation or heat shock treatment of the host cell.

Step (b) may include a cultivation step that allows growth of the host cells. Alternatively, such step allowing growth of the host cells and a step that allows expression of the protein or peptide may be performed separately in that the cells are first cultivated such that they grow to a desired density and then they are cultivated under conditions that allow expression of the peptide or protein of interest. The expression step can however still allow growth of the cells.

The method may further include a step of recovering the expressed protein or peptide. The protein or peptide may be recovered from the growth medium, if it is secreted, or the cells or both. The recovery of the peptide or protein may include various purification steps.

Generally, any known culture medium suitable for growth of the selected host may be employed in this method. In various embodiments, the medium is a rich medium or a minimal medium. Also contemplated herein is a method, wherein the steps of growing the cells and expressing the peptide or protein comprise the use of different media. For example, the growth step may be performed using a rich medium which is replaced by a minimal medium in the expression step. In certain cases, the medium is selected from the group consisting of LB medium, TB medium, 2YT medium, synthetical medium and minimal medium.

In some embodiments, glycerol is added to the culture medium in concentrations of 0.1 v/v % to up to 50 v/v %. The addition of glycerol to the growth medium may positively influence the amount of secreted peptide or protein. Without wishing to be bound to a specific theory, it is believed that the folding rate of the recombinantly expressed proteins and peptides in the cytoplasm of the expression host cell is reduced due to the presence of glycerol in the culture medium. As the intracellular peptide or protein folding rate is reduced, the secretion efficiency is increased.

In some embodiments, the above method further comprises the secretion of the recombinant peptide or protein into the culture medium by cultivating the host cell under conditions that allow secretion of the recombinant peptide or protein into the culture medium. The term "conditions that allow secretion of the recombinant peptide or protein into the culture medium" means that the temperature and medium are chosen such that the peptide or protein of interest is secreted. In certain embodiments, this involves supplementing the medium with an inducer of protein expression or changing a physical parameter to induce the protein expression. For example, if the vector encoding for the peptide or protein of interest is constructed such that the sequence encoding for the peptide or protein of interest is under transcriptional control, the addition of a substrate which releases the suppression of the transcriptional control may be added to the medium or the culture conditions may be reset to induce transcription. Thus, in some embodiments, the medium may be supplemented with IPTG, arabinose, tryptophan and/or maltose, and/or the culture temperature may be changed and/or the culture may be exposed to UV light. In various embodiments, the conditions that allow secretion of the recombinant peptide or protein are the same used for the expression of the peptide or protein.

In certain embodiments, the host cell is a prokaryotic cell, such as *E. coli*, in particular *E. coli* BL21 (DE3) and *E. coli* DH5α.

Furthermore, in various preferred embodiments where secretion is desired and the nucleic acid molecule or vector of the invention includes the third nucleic acid sequence encoding HlyA or a fragment thereof, the host cell may express the other components of the T1SS. These components may include HlyB and HlyD, wherein in some cases the two proteins are endogenously expressed, whereas in other cases the two proteins are recombinantly expressed. In the latter case, the nucleic acid molecules encoding for HlyB and/or HlyD may be comprised in the vector harboring the nucleic acid molecule of the present invention. Alternatively, both proteins are encoded together in one or two additional vectors. For example, HlyB and HlyD may be encoded in a single expression vector which comprises several integration sites for encoding nucleic acid sequences. Such a vector may also comprise a nucleic acid molecule of the present invention. Suitable vectors may be Duet vectors (Novagen) or derivates thereof. The above-mentioned one or two additional vectors may comprise selection markers which are the same or different from the selection marker of the vector of the present invention. Host cells comprising the desired combination of expression vectors can be easily selected if the selection markers of the employed vectors are different from each other. In some embodiments, if the host cell does not endogenously express TolC, a nucleic acid molecule encoding for TolC may also be comprised in one of the vectors comprised in the host cell or be introduced in the host with an additional vector. In certain embodiments, if the expression and secretion of the recombinant peptide or protein of the present invention is desired, the host cell expresses HlyB, HlyD and TolC in addition to the recombinant peptide or protein of the present invention. This allows for secretion of the recombinant peptide or protein, if the peptide or protein comprises HlyA, a C-terminal fragment thereof, as defined above, or a homolog thereof. Alternatively, the recombinant peptide or protein may also be secreted if the peptide or protein of interest is chosen from the group of type 1 secretion system substrates as disclosed herein.

In some embodiments, the entire culture of the host cell, e.g., during growth and expression, is carried out in minimal medium. In various embodiments, the method comprises secretion of the recombinant peptide or protein and during secretion the host cell may be cultivated in minimal medium. Minimal medium is advantageous if the recombinant peptide or protein is secreted, as the protein, lipid, carbohydrate, pigment, and impurity content in this medium is reduced and thus circumvents or reduces the need of extensive purification steps.

Furthermore, the inventors found that a supplementation of the culture medium with alkaline earth metal salts is advantageous for secretion of the recombinant peptide or protein of the present invention. For an improvement of the secretion the medium may be complemented at least during secretion or during the entire cell cultivation with at least one alkaline earth metal salt. In some embodiments, the final concentration in the medium is in the range of 1-40 mM. In certain embodiments, the secretion medium may be complemented with at least one alkaline earth metal salt selected from the group consisting of a magnesium salt, calcium salt, strontium salt, or barium salt. In some embodiments, the secretion medium comprises 1-40 mM of a calcium salt. The total concentration of 1-40 mM earth alkaline metal salt may be achieved by combining several salts from different earth alkaline metals and/or the same earth alkaline metal. If the earth alkaline metal is selected from magnesium salt, calcium salt, strontium salt, or barium salt, the composition may comprise 1-40 mM of a single calcium, strontium or barium salt or combinations of several magnesium, calcium, strontium or barium salts, leading to a total concentration in the range of 1-40 mM. In particular, a calcium salt concentration in the range of 1-40 mM may be achieved by combining several calcium salts leading to a total concentration of 1-40 mM. In certain embodiments, the calcium salts are selected from the group consisting of $CaCl_2$, $CaCO_3$, $Ca(OH)_2$, $CaSO_4 \cdot 2H_2O$, $Ca_3(PO_4)_2$, $Ca(CH_3COO)_2 \cdot H_2O$, and $Ca(C_2H_3O_2)_2$. In one specific embodiment, the medium contains 1-40 mM $Ca^{2+}$ ions. The medium supplemented accordingly, may be the medium used in the cultivation step that allows expression and/or secretion of the peptide or protein.

In particular if the recombinant peptide or protein of the present invention comprises one or more GG repeats of HlyA the secretion efficiency is significantly raised if the medium is supplemented with earth alkaline metal salts. Thus, in some embodiments, the recombinant peptide or protein comprises at least an amino acid sequence as set forth in any one of SEQ ID NO:41-49 or C-terminal fragments thereof, wherein the amino acid sequence comprises at least the sequence as set forth in SEQ ID:49 or homologs thereof having at least 91% sequence identity.

In certain embodiments, the expressed recombinant peptide or protein is a recombinant peptide or protein as disclosed herein. In some embodiments, the expressed and secreted protein is selected from the above described group of proteins and peptides.

In various embodiments, the method also encompasses the purification the recombinant peptide or protein, wherein the recombinant peptide or protein is purified using a method selected from affinity chromatography, ion exchange chromatography, reverse phase chromatography, size exclusion chromatography, and combinations thereof.

In several embodiments, the method may comprise the treatment of the recombinant peptide or protein with a protease suitable for cleavage of a protease cleavage site within the recombinant peptide or protein. In some embodiments, the recombinant peptide or protein is purified prior to proteolytic cleavage using one or more methods disclosed above. Also after cleavage of the recombinant peptide or protein, the method may comprise a further purification step as defined above. Thus, in some embodiments the recombinant peptide or protein is purified, subjected to proteolytic cleavage and the peptide or protein of interest is further purified.

After the purification and/or secretion of the peptide or protein of the present invention, in particular of the peptide or protein of interest, the peptide or protein may be fused to a moiety that extends the serum half-life of the peptide or protein. Such moieties are well-known in the art and those skilled in the art may resort to routine practice to identify suitable moieties. Exemplary moieties include, but are not limited to an Fc part of an immunoglobulin, a CH3 domain of an immunoglobulin, a CH4 domain of an immunoglobulin, albumin or an albumin fragment, an albumin binding peptide, an albumin binding protein, transferrin, a polyalkylene glycol molecule, hydroxyethyl starch, palmitic acid and other fatty acid molecules. The fusion may be to the N- or C-terminus, but also may be to an amino acid side chain that is amenable to such modification, including cysteine, lysine, serine, threonine, glutamic acid and aspartic acid side chains.

In various other embodiments, cysteine residues in the polypeptide sequence of the peptide or protein of the present invention, e.g., the peptide or protein of interest, may be mutated to other amino acids or deleted, for example to prevent disulphide bridge formation. In other embodiments, the peptide or protein of the invention may include one or more amino acids that are mutated to cysteine residues in order to generate coupling sites for modifications, for example for the conjugation to other compounds, such as polyethylene glycol (PEG), biotin, peptides or proteins, or for the formation of non-naturally occurring disulphide linkages. Thus, the above described method may also comprise the coupling of compounds, such as polyethylene glycol (PEG), biotin, peptides or proteins, or for the formation of non-naturally occurring disulphide linkages.

In a further aspect, the present invention relates to the use of a vector or nucleic acid molecule as disclosed herein for the expression of a recombinant peptide or protein. In some embodiments, the vector is used for the expression and secretion of a recombinant peptide or protein. The expression or expression and secretion may be achieved using the method described herein.

In a further aspect, the inventors found that the secretion of a peptide or protein of interest can be achieved and/or improved compared to other secretion systems if the sequence encoding for the peptide or protein of interest is comprised in a nucleic acid molecule wherein 3" to this sequence encoding for the peptide or protein of interest a sequence encoding for a specific HlyA fragment is present, wherein the fragment consists of the nucleotide sequence as set forth in SEQ ID NO:34 or the complement thereof. Fusion proteins encoded by these nucleic molecules are more efficiently secreted than known fusion proteins employing Type 1 secretions systems. Furthermore, the fusion proteins of the present invention are more efficiently secreted than fusion proteins involving other secretion systems. Moreover, the secretion of the fusion proteins of the present invention via a Type 1 secretion system allows the direct export of the fusion proteins to the extracellular environment and avoids proteolytic damage of these fusion proteins and increases stability of the fusion proteins in the extracellular space.

Therefore, the present invention also relates to a nucleic acid molecule comprising or consisting of a first nucleic acid sequence, wherein said first nucleic acid sequences has the nucleotide sequence set forth in SEQ ID NO:34 or the complement thereof. Alternatively, the first nucleic acid sequence may have a nucleotide sequence that has at least 70%, at least 80, at least 90, at least 95, at least 97.5, at least 99 or at least 99.5% sequence identity with the nucleotide sequence as set forth in SEQ ID NO:34 or the complement thereof. In another embodiment, it has a nucleotide sequence encoding the polypeptide with the amino acid sequence set forth in SEQ ID NO:46 or a homolog thereof. The homolog of the sequence set forth in SEQ ID NO:46 shares at least 80, preferably 90, more preferably 91, even more preferably 95% or more sequence identity with the amino acid sequence set forth in SEQ ID NO:46 and, in preferred embodiments, has the same length.

The nucleic acid molecule of this aspect of the invention does not include the full length sequence encoding HlyA, as for example set forth in SEQ ID NO:29. In various embodiments, the nucleic acid molecule of the invention does also not encode a HlyA full length protein or fragment thereof other than that set forth in SEQ ID NO:46 or its homolog. This means that in various embodiments, the nucleotide sequence having at least 70, 80, 90, 95, 97.5, 99, or 99.5% sequence identity to the sequence set forth in SEQ ID NO:34 still encodes for the polypeptide of SEQ ID NO:46 or a homolog thereof.

A nucleic acid molecule according to this aspect of the invention can thus comprise or consists of the first nucleic acid sequence as defined above and a second nucleic acid sequence, wherein the second nucleic acid sequence encodes for at least one peptide or protein of interest. The second nucleic acid sequence may be located 5" or 3" of the first nucleic acid sequence but preferably is 5" of the first nucleic acid sequence. Both sequences may be directly adjacent to each other or connected by a linker sequence.

The second nucleic acid sequence encoding for a peptide or protein of interest may be defined as described above in connection with the other aspects of the invention, in particular the nucleic acid constructs comprising HlyC sequence fragments.

The nucleic acid molecule according to this aspect can further comprises at least one third nucleic acid sequence encoding for an affinity tag and/or a protease cleavage site, wherein the at least one third nucleic acid sequence is operably linked to the 5" and/or 3" end of the first nucleic acid molecule and/or the at least one second nucleic acid molecule. The third nucleic acid sequence is defined similar to the fourth nucleic acid sequence described above in connection with the HlyC fragment containing nucleic acid molecules.

In some embodiments, the nucleic acid molecule according to this aspect comprises or consists of a nucleic acid sequence as set forth in any one of SEQ ID Nos. 67, 72, 75, 80, 85, 90, 94, 99, 104, 111, 116, 121, 126, 131, 136, 141, 146, 221, 228, 235, 240, 245, 250, 255, 260, 265, 270, 275, 280, 285, 290, 295, 300, 305, 315, 326, 328, 330, and 332.

In further embodiments, the nucleic acid molecule comprises at least the first and second nucleic acid sequences as defined above and is constructed such that the first nucleic acid sequence is translated into an individual peptide or protein. In various embodiments, the nucleic acid molecule comprises at least the first and second nucleic acid sequences as defined above and is constructed such that the first and second nucleic acid sequences are translated into a fusion peptide or protein. The nucleic acid molecule may be constructed such that once the nucleic acid sequence is translated the peptide or protein encoded by the first nucleic acid sequence and the peptide or protein encoded by the second nucleic acid sequence are fused. "Fused", as used in this context, means that the resulting peptides or proteins are directly connected to each other or are linked by one or more amino acids, peptides or proteins, e.g., one or more protease cleavage sites and/or affinity tags.

The nucleic acid molecules of this aspect of the invention may be comprised in vectors that are defined as described above in connection with the other nucleic acid constructs of the invention. Similarly, these nucleic acid molecules and vectors may be comprised in host cells, as defined above. Also encompassed are the recombinant peptides or proteins encoded by these nucleic acid molecules. In various aspects, these recombinant peptides or proteins comprise or consist of an amino acid sequence selected from the group consisting of SEQ ID Nos. 46, 68, 73, 76, 81, 86, 91, 95, 100, 105, 113, 117, 122, 127, 132, 137, 142, 147-150, 222, 229, 236, 241, 246, 251, 256, 261, 266, 271, 276, 281, 286, 291, 296, 301, 306, 316, and 333-336.

A method for expression of a recombinant peptide or protein using the above-described nucleic acid molecules may comprise the steps of:
(a) introducing a nucleic acid molecule or a vector as described above into a suitable host cell, wherein the nucleic acid molecule or vector encodes the recombinant peptide or protein; and
(b) cultivating the host cell in a culture medium under conditions that allow expression of the recombinant peptide or protein and optionally secretion of the recombinant peptide or protein into the culture medium.

The method can further be defined as the other methods of the invention described above. Specifically, the method may further comprise recovering the expressed peptide or protein from the host cell and/or the culture medium. In addition, the host cell may be a prokaryotic cell; and/or the host cell may express HlyB and HlyD; and/or the expression may be performed in minimal culture medium; and/or the culture medium may comprise 1-40 mM of $Ca^{2+}$; and/or the expressed recombinant peptide or protein may be the recombinant peptide or protein described above and comprise or consist of an amino acid sequence selected from the group consisting of SEQ ID Nos. 46, 68, 73, 76, 81, 86, 91, 95, 100, 105, 113, 117, 122, 127, 132, 137, 142, 147-150, 222, 229, 236, 241, 246, 251, 256, 261, 266, 271, 276, 281, 286, 291, 296, 301, 306, 316, and 333-336; and/or the recombinant peptide or protein may be purified using a method selected from affinity chromatography, ion exchange chromatography, reverse phase chromatography, size exclusion chromatography, and combinations thereof; and/or the method may comprises treatment of the recombinant peptide or protein with a protease suitable for cleavage of a protease cleavage site within the recombinant peptide or protein; and/or the method may comprise a cleavage step followed by purification of the recombinant peptide or protein.

It is understood that the specific embodiments described above in relation to the methods of expressing proteins and peptides using the HlyC/gap containing nucleic acid molecules are also intended to apply to the methods of expressing proteins and peptides using the specific HlyA fragment containing nucleic acid molecules.

EXAMPLES

Materials and Methods

Expression host: *Escherichia coli* BL21 (DE3) (Novagen)

Plasmids for HlyB and HlyD expression: pSJ37 HlyB,D or pK184 HlyB,D have been previously described in Jenewein, S. (2008), Dissertation Heinrich-Heine-University Dusseldorf and Bakkes et al. (2010) JBC; 285(52):40573-80, respectively.

All oligonucleotides were purchased from Eurofins MWG.

Codon optimized nucleotide sequences encoding for exenatide, human calcitonin, salmon calcitonin, Fuzeon, and human corticotropin release factor were purchased from Genscript. The nucleotide sequence encoding for HlyC of plasmid pHly152 was purchased from Genscript.

All enzymes were purchased from NEB, Clontech, Invitrogen or Fermentas.

Expression Protocol

1. Transformation of chemically competent cells with an expression vector encoding for the peptide or protein of interest and plating of the transformed cells on LB agar plates comprising suitable antibiotic(s) for selection of the transformed cells.

2. Incubation of the agar plates over night at 37° C.

3. Inoculation of 2YT medium comprising antibiotics with a single colony from the agar plate for an overnight culture.

4. Incubation at 37° C. and shaking of the culture over night.

5. Inoculation of the main culture comprising 2YT medium and optionally 5 mM $CaCl_2$ with the overnight culture resulting in an $OD_{600}$ of 0.01-0.2 (flasks+/−baffles, depending on the protein to be secreted)

6. Incubation of the culture at 37° C. at different rpm, depending on the identity of the peptide or protein of interest.

7. Induction of the expression the peptide or protein of interest with 1 mM IPTG at an $OD_{600}$ of 0.4-1.0.

8. Incubation of the cultures for 4-8 hrs, depending on the protein to be expressed.

9. Centrifugation of the cells for 30 min at 50.000 g and 4° C.

10. Lysis of the bacterial cells.

11. Chromatographic purification via FPLC using a size-exclusion column (Superdex 75 16/60) to separate the protein of interest from further lysate components.

Expression and Secretion Protocol

1. Transformation of chemically competent cells with an expression vector encoding for the peptide or protein of interest fused to a secretion substrate, e.g., pSU-A1+fusion peptide/protein, and an expression vector encoding for HlyB and HlyD and plating of the transformed cells on LB agar plates comprising suitable antibiotic(s) for selection of the transformed cells, e.g., ampicillin and kanamycin.

2. Incubation over night at 37° C.

3. Inoculation of 2YT medium comprising antibiotics with a single colony for an overnight culture.

4. Incubation at 37° C. and shaking of the culture over night.

5. Inoculation of the main culture and optionally 5 mM $CaCl_2$ with the overnight culture resulting in an $OD_{600}$ of 0.01-0.2 (flasks+/−baffles, depending on the protein to be secreted)

6. Incubation of the culture at 37° C. at different rpm, depending on the identity of the peptide or protein of interest.

7. Induction of the expression of the peptide or protein of interest fused to a secretion substrate and of the transport complex—consisting of HlyB and HlyD, encoded by pSJ37 or pK184 HlyB, D (TolC, the third protein of this transport complex is consecutively endogenously expressed in *E. coli*) with 1 mM IPTG at an $OD_{600}$ of 0.4-1-0-

8. Incubation of the cultures for 4-8 hrs, depending on the protein to be secreted.

9. Optionally: centrifugation of the cells for 30 min at 50.000 g and 4° C.

10. Concentration of the cell-free medium.

11. Optionally: Chromatographic purification via FPLC using a size-exclusion column (Superdex 75 16/60) to separate remaining components of the medium.

Example 1

Cloning of HlyA Fragments

All cloning procedures were done with the InFusionAdvantage Cloning Kit (ClonTech). General molecular biology procedures are well known to the person skilled in the art (Sambrook et al., 2001, supra)

In brief, the cloning of pSU-HlyA1 was performed as follows: the parental plasmid pSU-HlyA full length (SEQ ID NO:62) comprising the sequence encoding for the HlyC fragment and gap sequence (SEQ ID NO:12) and HlyA (SEQ ID NO:29) was amplified with the oligonucleotides pSU HlyA_lin_for (5'-TATATTAATTTAAATGATAGCAATCTTACTG-3', SEQ ID NO:53) and pSU HlyA_lin_rev (5'-TTAATTACCTCTTAACCAGTTAATG-3', SEQ ID NO:54) to generate a linearized plasmid. The gene encoding for HlyA1 was amplified from the same plasmid (pSU-HlyA) with the oligonucleotides pSU-HlyA1_for (5'-TTAAGAGGTAATTAAATGGGAAATTCTCTTG-CAAAAAATG-3', SEQ ID NO:55) and pSU-HlyA1_rev (5'-ATTTAAATTAATATATTATGCTGATGTGGTCAG-3', SEQ ID NO:56) that contain 15 bp 5' elongations, which are complementary to the ends of the linearized vector to allow the In-Fusion reaction. The gel-extracted PCR products of both separate reactions were used for the In-Fusion reaction as described in the manual (ClonTech). The resulting vector pSU-HlyA1 had the sequence as set forth in SEQ ID NO:63. The sequence encoding for HlyA1 corresponds to the sequence as set forth in SEQ ID NO:34. The encoded protein (SEQ ID NO:46) comprises 3 conserved GG repeats.

All other C-terminal fragments of HlyA in pSU were generated in the same way using an adapted forward primer for the amplification of the desired insert.

Further exemplary constructs were HlyA 7GG repeats, HlyA 4GG repeats, HlyA 2GG repeats, HlyA 1GG repeat, HlyA non-conserved GG repeat, HlyA no GG repeat (encoding sequences SEQ ID Nos:32, 33, 35, 36, 37, and 38, the corresponding polypeptide sequences SEQ ID Nos:44, 45, 47, 48, 49, and 50).

In case the generation of a C-terminal fragment is desired, lacking up to the last 8 C-terminal amino acids of the HlyA polypeptide chain, the reverse primer can be accordingly adjusted.

Analogous strategies were employed for the generation of the corresponding pSU vector constructs lacking the sequence encoding for the HlyC fragment and the gap sequence and the cloning of the corresponding pBAD vector constructs or pET vector constructs, respectively.

Example 2

Optimization of the Secretion Substrate Tag

Figure 2:
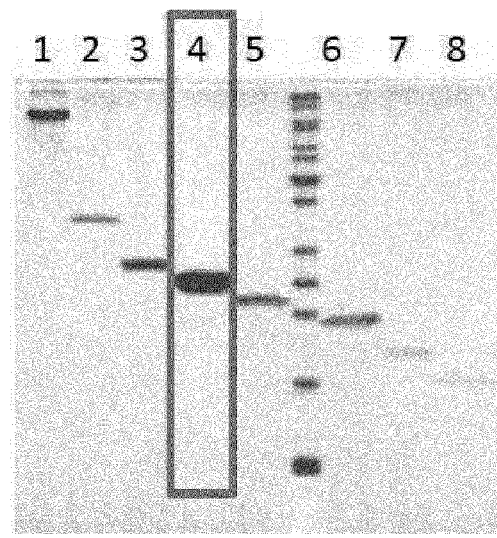
FIG. 2 shows a Coomassie-stained SDS-PAGE gel, wherein the lanes have been loaded with cell culture supernatant from *E. coli* co-expressing HlyB, HlyD and full length HlyA (lane 1), a HlyA C-terminal fragment including 7 GG repeats (lane 2), a HlyA C-terminal fragment including 4 GG repeats (lane 3), a HlyA C-terminal fragment including 3 GG repeats (=HlyA1, lane 4), a HlyA C-terminal fragment including 2 GG repeats (lane 5), a HlyA C-terminal fragment including 1 GG repeat (lane 6), a HlyA C-terminal fragment including a non-conserved GG repeat (lane 7), or a HlyA C-terminal fragment without any GG repeat (lane 8) and a molecular weight marker (between lanes 5 and 6).
Figure 3:
FIG. 3 shows the exemplary nucleotide sequence architecture of a nucleic acid sequence for use in HlyA1-fusion protein expression. A 148 NT long, 3" fragment of hemolysin C is fused via the 3" terminus to the 11 NT long gap and a 657 NT long 3" terminal fragment of the full length HlyA (=HlyA1) encoding nucleotide sequence. A nucleic acid molecule having this architecture is the nucleic acid molecule consisting of the nucleotide sequence as set forth in SEQ ID NO:154.

In order to optimize the expression and secretion of the peptide or protein of interest, first the expression and secretion of the secretion substrate HlyA and fragments thereof was investigated. Several pSU-vector based HlyA truncation constructs were generated in order to identify the HlyA fragment which confers the peptide or protein of interest the best expression and secretion profile. Therefore, *E. coli* BL21 (DE3) cells were co-transformed with the pK184 HlyB,D vector encoding for HlyB and HlyD and the pSU vector encoding HlyA or fragment thereof and plated on an agar plate. The protein expression was carried out as detailed above. After 5 h the cells were pelleted by centrifugation and the culture medium saved for further investigation. A 16 µl aliquot of each expression culture was loaded on an SDS-gel without prior purification. After running of the gel, the protein bands were detected using Coomassie brilliant blue staining. The results are shown in FIG. 2. Lanes 1-8 correspond to the proteins encoded by the nucleotide sequences set forth in SEQ ID Nos: 29, 32-38 (protein sequences are set forth in SEQ ID Nos. 41, 44-50), with the proteins encoded by SEQ ID Nos. 32-38 and having the amino acid sequence set forth in SEQ ID Nos. 44-50 having an additional start methionine in the polypeptide chain. As FIG. 3 shows, all secretion substrate tags were successfully expressed and secreted. The best results were obtained for HlyA1 (lane 4; SEQ ID Nos. 34 and 46).

Example 3

Analysis of the HlyA1 Expression Construct

During sequencing of the above-described HlyA constructs it was found that the parent vector pSU-HlyA comprised a non-translated nucleotide sequence between the promoter region and the sequence encoding for HlyA and that this sequence has also been passed to the vectors encoding for the above-described HlyA fragments. This structure is highlighted in FIG. 3 for the HlyA1 construct. As indicated, the mRNA resulting from the transcription of the vector comprises a non-translated HlyC fragment and a gap sequence (corresponding to the sequence as set forth in SEQ ID NO:12). These sequences are probably derived from a non-PCR based cloning of HlyA which led to the integration of further hemolysin operon elements, namely a fragment of the HlyC encoding sequence and the gap sequence between the HlyC and HlyA encoding element. For the structure of this particular hemolysin operon cf. FIG. 1.

Figure 4A:
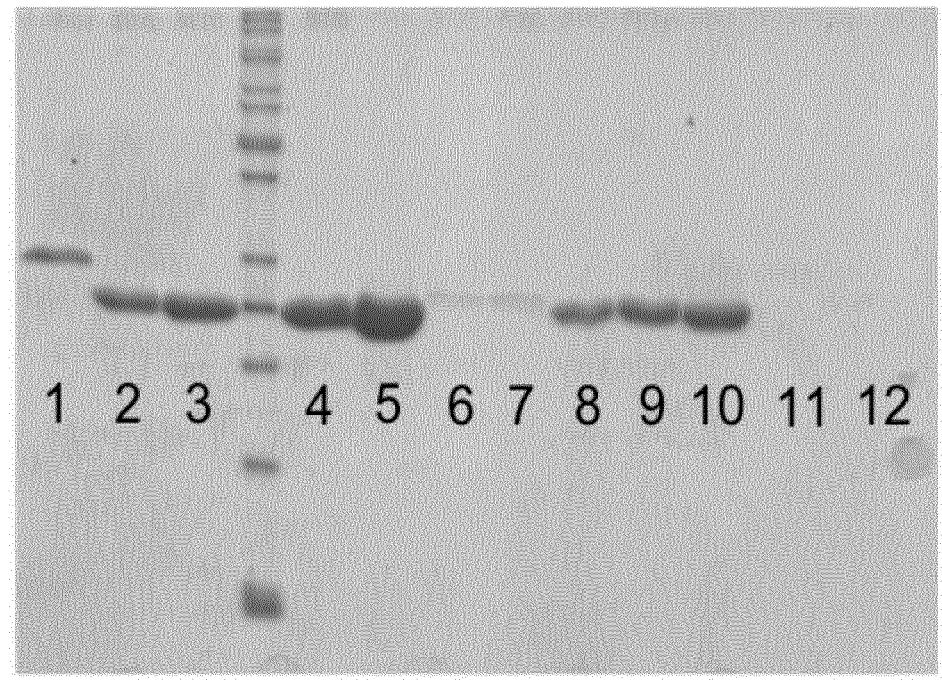
FIG. 4 shows Coomassie-stained SDS-PAGE gels, wherein the upper gel (FIG. 4A) has been loaded with samples from *E. coli* BL21 DE3 culture supernatant and the lower gel (FIG. 4B) with the corresponding cells. The lanes have been loaded with samples originating from cells which were co-expressing HlyB, HlyD, and 1) HlyAc (pSOI-HlyAc vector of Bakkes et al. (2010) J. Biol. Chem.; 285(52):40573-80), 2) HlyA1 (SEQ ID NO:46, a C-terminal fragment of full length HlyA consisting of 7 GG repeats and the entire secretion sequence, pBAD), 3) and 4) HlyA1 (wherein the pBAD vector comprises a nucleotide sequence as shown in FIG. 3, namely a 3, terminal fragment of HlyC, the gap sequence, and an HlyA fragment as set forth in SEQ VID NO:154), 5) HlyA1 (the same nucleotide construct as in 3) and 4) but within the pSU vector. The entire vector has the nucleotide sequence as set forth in SEQ ID NO:63. 6) and 7) HlyA1 (the vector used in 5) lacking the HlyC fragment and gap sequence, i.e. lacking the sequence set forth in SEQ ID NO:12), 8) and 9) HlyA1 (the vector used in 5) lacking the HlyC fragment but including the gap sequence, i.e. including SEQ ID NO:2 instead of SEQ ID NO:12, and 10) HlyAc (the HlyA variant of 1) cloned in the pSU vector comprising the HlyC fragment and gap sequence as set forth in SEQ ID NO:12.
Figure 4B:
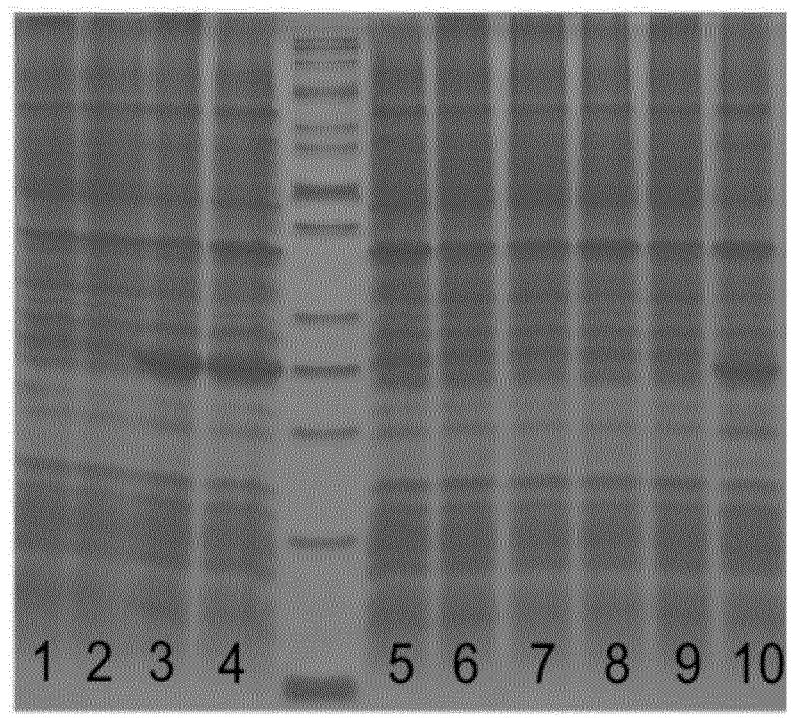

In order to further analyze the HylA1 expression construct and the relevance of the additionally integrated non-translated sequences having a sequence as set forth in SEQ ID NO:159, further experiments were carried out comparing the expression and secretion of HlyA1 with or without the presence of the sequence as set forth in SEQ ID NO:12 and the results were compared with the previously published HlyAc construct (pSOI-HlyAc, Bakkes et al. (2010) J. Biol. Chem.; 285(52):40573-80, comprising a sequence encoding for a fragment from a distantly related HlyA type 1 secretion system substrate, a His-tag and a TEV cleavage site on the vector pBAD). The results are shown in FIG. 4, wherein FIG. 4A shows a stained SDS-gel on which cell culture supernatants have been loaded, whereas FIG. 4B shows a stained SDS-gel on which raw lysate from the corresponding cells has been loaded. Lane 1: pSOI-HlyAc (Bakkes et al. (2010) J. Biol. Chem.; 285(52):40573-80, comprising a sequence encoding for a fragment from a related HlyA type 1 secretion system substrate, a His-tag and a TEV cleavage site on the vector pBAD), lane 2: pSOI-HlyA1 (encoding for the HlyA1 (SEQ ID Nos. 34, 46), pBAD vector), lanes 3 & 4: pSOI-HlyA1+HlyC fragment+gap (vector comprising the same insert as pSU-HlyA1), lane 5: pSU-HlyA1 (vector comprising the HlyC fragment and gap sequence; SEQ ID NO:63), lanes 6 & 7: pSU-HlyA1 minus HlyC fragment and gap (pSU vector comprising the insert sequence encoding for HlyA1 only (SEQ ID NO:176)), lanes 8 & 9: pSU-HlyA1+gap (pSU vector comprising the sequences encoding for HlyA1 and corresponding to the gap sequence (SEQ ID Nos. 2 and 34)), and lane 10: pSU-HlyAc (pSU vector comprising the HlyC fragment and gap sequence (SEQ ID NO:12) 5" to the sequence encoding for HlyAc).

As can be concluded from the comparison of lane 5 with lane 10, HlyA1 is much more efficiently expressed and secreted than the previously described HlyAc. Furthermore, the comparison of lanes 6 & 7 with 8 & 9 shows that the presence of the gap sequence 5" to the HlyA1 encoding sequence is advantageous for expression and secretion of HlyA1. The expression is even more increased if the vector comprises both, the HlyC fragment and gap sequence (cf. lane 5 and lanes 6 & 7). In addition, HlyA1 is efficiently expressed and secreted if the pBAD vector is lacking the HlyC fragment and gap sequence (lane 2). Nevertheless, the expression is increased if these two sequences are integrated into the pBAD vector (lanes 3 & 4). Thus, the inventors found that the use of HlyA1 is advantageous over the previously described HlyAc. Furthermore, the presence of the sequence encoding for the HlyC fragment and the gap sequence 5" to the sequence encoding for HlyA1 or HlyAc raises the expression and secretion of both proteins. Thus, it can be concluded that these sequences enhance the expression of peptides and proteins in general. Furthermore, sequencing of the pSU plasmid revealed that the vector comprises an origin of replication homologous to low copy origins, whereas the pBAD is a low to intermediate copy vector. Thus, the use of the pSU vector is of particular advantage over the pBAD in the presence of the HlyC fragment and the gap sequence (compare the HlyA1 expression in lanes 3 & 4 with lane 5 and lanes 6 & 7) and it appears that the use of low copy vectors is particularly advantageous in combination with the HylC fragment and the gap sequence.

Example 4

Expression/Secretion of HlyA1

Figure 5:
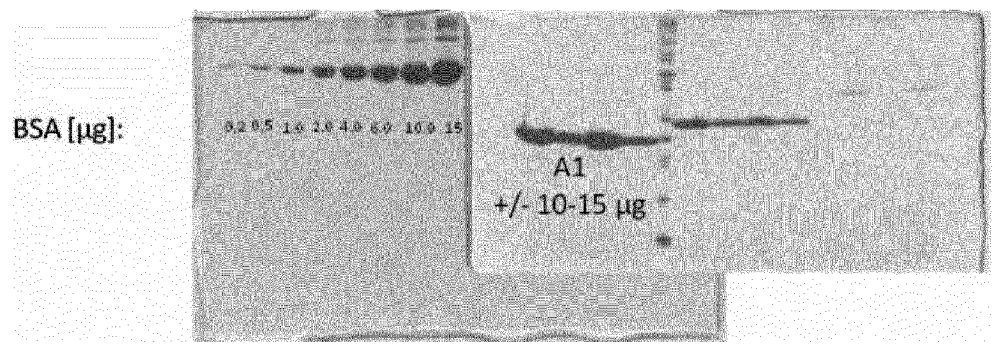
FIG. 5 shows two SDS-PAGE gels, wherein the left gel has been loaded with varying amounts of BSA as an internal standard for the estimation of the amount of secreted HlyA1 (SEQ ID NO:46) loaded on the right gel. On the right gel 16 μl/lane of cell culture supernatant have been loaded. The supernatant was obtained from cultures 5 hrs after induction of secretion. Between 625-930 mg HlyA1/liter medium were obtained.

In order to determine the mean expression and secretion rate for HlyA1 (SEQ ID NO:46), several cultures comprising this expression construct (SEQ ID NO:63) were run in parallel, as described above. 5 hrs after the induction of the expression (the $OD_{600}$ of the medium was about 5), the expression protocols are given above, the cells were separated from the cell culture supernatant and 16 µl of supernatant loaded on an SDS-PAGE gel. In parallel, a second SDS-PAGE gel was loaded with defined amounts of a BSA dilution. After completion of the electrophoresis both gels were stained with Coomassie brilliant blue (FIG. 5). Using a densitometric approach the staining intensities of the BSA gel served a as a rough calibration for the assessment of the bands detected on the HlyA gel and the determination of the amounts of secreted protein. The quantification revealed that between 625-930 mg HlyA1 were secreted per liter of culture medium corresponding to about 200 mg/OD and liter of cell culture which is about 30 fold higher than the previously published results obtained for HlyAc (Bakkes et al. (2010) J. Biol. Chem.; 285(52):40573-80).

Example 5

Purification of HlyA1

A 50 ml sample of the above-described cell culture supernatant was subjected to size-exclusion chromatography. Fractions of 3 ml were taken and analyzed using SDS-PAGE. 550 µl of HlyA1 with a protein concentration of 20.5 mg/ml were obtained. The results demonstrate that a homogenous HlyA1 sample was obtained after the size-exclusion chromatography (data not shown).

Example 6

Expression of HlyA1 in Minimal Medium

Figure 6:
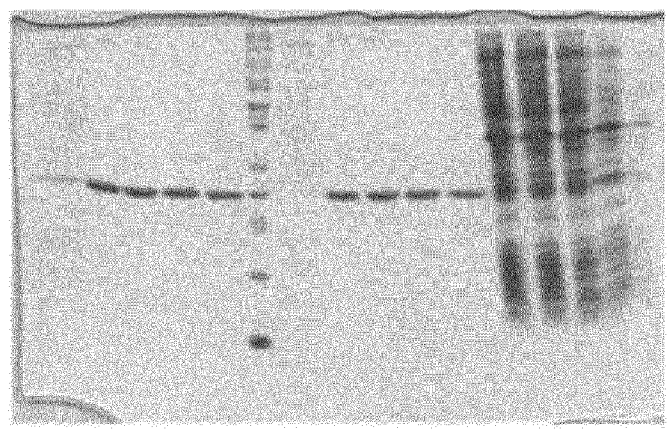
FIG. 6 shows an SDS-PAGE gel onto which 16 μl/lane cell culture supernatants (lanes 2-5 and 7-10), molecular weight marker (lane 6), and whole cell lysate (lanes 11-14) were loaded. The cells have been transformed for HlyA1 (SEQ ID NO:46) expression and secretion and were cultivated in minimal medium. The secretion was induced at an $OD_{600}$ of 0.6 and the cells further cultured for 5 hours, up to an $OD_{600}$ of 1.4.

HlyA1 was expressed and secreted in minimal medium, as this reduces the purification efforts. E. coli BL21 (DE3) pSU-HlyA1 (SEQ ID NO:63)+pk184 HlyB,D (Jenewein; Bakkes et al., supra) co-transformants were picked from the above described agar plate and cultivated over night. An aliquot of each culture was transferred to expression culture media comprising minimal medium supplemented with the suitable antibiotics, leading to an $OD_{600}$ of 0.1. When the cultures reached an $OD_{600}$ of 0.6 the expression and secretion was induced using IPTG and the cultivation continued for further 5 hrs, reaching an $OD_{600}$ of 1.4. Then the cells were separated from the culture medium by centrifugation. A 16 µl aliquot of each cell culture supernatant and whole cell lysate from selected cultures was loaded on an SDS-gel. The quantification revealed that HlyA1 was secreted to an extent of 100 mg/OD (FIG. 6).

Example 7

Construction of HlyA1 Fusion Proteins

In order to investigate the efficiency of HlyA1 assisted expression and secretion of peptides or proteins of interest, several HlyA1 fusion proteins were generated. Therefore, the pSU-HlyA1 vector (SEQ ID NO:63) was used as integration site of the sequence encoding for the peptide or protein of interest. The sequences encoding for the peptides or proteins of interest were integrated between the start codon of HlyA1 and the remainder of the HlyA1 sequence.

Cloning of Interferon Alpha 2b [*Homo sapiens*]

pSU-HlyA1 was amplified with the oligonucleotides pSU HlyA1_lin_for (5'-GGAAATTCTCTTGCAAAAAATGT-ATTA-3', SEQ ID NO:57) and pSU HlyA1_lin_rev (5'-CATTTAATTACCTCTTAACCAGTTAATG-3', SEQ ID NO:58) to generate a linearized plasmid.

Generally, the genes of interest were amplified from a template DNA with primer oligonucleotides annealing to the first codon after the start-ATG (forward) and to the last amino acid lacking the stop-codon (reverse). The primer oligonucleotides comprised additional 15 bp of the sequence 5'-AGAGGTAATTAAATG-3' (forward; SEQ ID NO:160) and 5'-TGCAAGAGAATTTCC-3' (reverse; SEQ ID NO:161) on their 5" ends to generate fragments having ends homologous to the linearized pSU-HlyA1 vector.

For the amplification of the IFNα2 gene a vector comprising the interferon alpha 2 sequence encoding for INFα2 (GenBank: ACCESSION: NP_000596, VERSION: NP_000596.2 GI:11067751, uniprot accession no: Q86UP4 (Last modified Jul. 27, 2011. Version 48) was chosen as template. The following oligonucleotides were used in the amplification reaction:

```
pSU-IFN2a_for
(AGAGGTAATTAAATGTGTGATCTGCCGCAGACTC,
SEQ ID NO: 59)
and pSU-IFN2a_rev
(TGCAAGAGAATTTCCTTCCTTACTTCTTAAACTTTCTTGCAAGTTT,
SEQ ID NO: 60).
```

For the construction of a fusion protein comprising a Factor Xa cleavage site between HlyA1 and interferon alpha 2, the amplification reaction was carried out with the same forward and the following reverse primer:

```
                                    (SEQ ID NO: 61)
5'-TGCAAGAGAATTTCCACGGCCATCAATTTCCTTACTTCTTAAACTTT

CTTGCAAGTTT-3'
```

Underlined letters mark the codons encoding the Xa site (reverse and complementary, encoded amino acid sequence: IDGR), bold letter corresponds to the end of linearized pSU-A1 with the start-ATG, italic letters corresponds to the end of linearized pSU-HlyA1 comprising the HlyA1 gene.

The In-Fusion reaction was performed according to the manual (ClonTech) with gel-extracted PCR products. The resulting nucleic acid construct comprising the HlyC fragment and gap sequence, interferon alpha 2 and HlyA1 had a nucleotide sequence as set forth in SEQ ID NO:125 and encoded for a protein having an amino acid sequence as set forth in SEQ ID NO:127.

Similarly, Calbindin (CalB), beta amyloid precursor Mab40, beta amyloid precursor Mab42, Alzheimer peptide binding protein (Zab3), exenatide, Fuzeon, human calcitonin, salmon calcitonin, human corticotrophin release factor, dimeric human corticotrophin release factor, human interferon gamma, murine interferon gamma, nisin, ifnar12, ifnar34, and IFABP, were cloned using the following primers to give the indicated encoding sequence and protein sequence. Usually, vector DNA comprising a gene encoding for the peptide or protein of interest served as a template for the amplification reaction, except for exenatide, human calcitonin, salmon calcitonin, Fuzeon, and human corticotropin release factor where synthetic DNA served as a template. The synthetic nucleotide sequences were codon optimized for *E. coli* expression.

| Peptide/ protein of interest | wildtype protein Accession No., Version No., date | Construct | Forward primer SEQ ID NO: | Reverse primer SEQ ID NO: | Vector insert sequence/ encoding sequence SEQ ID NO: | Protein sequence/ SEQ ID NO: |
|---|---|---|---|---|---|---|
| CalB | ACCESSION P41365 VERSION P41365.1 GI:1170790, PLN 31 MAY 2011 | HlyCfragm-gap-CalB-HlyA1 | 64 | 65 | 66/67 | 68 |
| beta-amyloid peptide precursor [*Homo sapiens*], 40 amino acids | ACCESSION AAB26265 VERSION AAB26265.2 GI:8176534, 14 JUL. 2000 | HlyCfragm-gap-Mab40-HlyA1 | 69 | 70 | 71/72 | 73 |
| beta-amyloid peptide precursor [*Homo sapiens*], 42 amino acids, | ACCESSION AAB26265 VERSION AAB26265.2 GI:8176534, 14 JUL. 2000 | HlyCfragm-gap-Mab42-HlyA1 | 155 | 156 | 74/75 | 76 |
| Alzheimer peptide binding protein (Zab3) with His-Tag | 2OTK_E VERSION 2OTK_E GI:167744864, 13 FEB. 2008 | HlyCfragm-gap-Zab3-HlyA1 | 77 | 78 | 79/80 | 81 |
| Exenatide | 1JRJ_A VERSION 1JRJ_A GI:17942697, VRT 10, JUL. 2009 | HlyCfragm-gap-Exenatide-HlyA1 | 82 | 83 | 84/85 | 86 |

-continued

| Peptide/ protein of interest | wildtype protein Accession No., Version No., date | Construct | Forward primer SEQ ID NO: | Reverse primer SEQ ID NO: | Vector insert sequence/ encoding sequence SEQ ID NO: | Protein sequence/ SEQ ID NO: |
|---|---|---|---|---|---|---|
| Fuzeon | ACCESSION 3H00_A VERSION 3H00_A GI:281307071, VRL 19 DEC. 2009 | HlyCfragm-gap-Fuzeon-HlyA1 | 87 | 88 | 89/90 | 91 |
| human calcitonin | ACCESSION ACB14881 VERSION ACB14881.1 GI:170320110, SYN 24 MAR. 2008 | HlyCfragm-gap-hu calcitonin-HlyA1 | 92 | 151 | 93/94 | 95 |
| salmon calcitonin | ACCESSION BAA00281 VERSION BAA00281.1 GI:220946, SYN 21 MAY 2003 | HlyCfragm-gap-sal calcitonin-HlyA1 | 96 | 97 | 98/99 | 100 |
| human corticotropin release factor | ACCESSION AAX18228 VERSION AAX18228.1 GI:60280464, VRT 01 OCT. 2005 | HlyCfragm-gap-HCRF-HlyA1 | 101 | 102 | 103/104 | 105 |
| Double human corticotropin release factor | ACCESSION AAX18228 VERSION AAX18228.1 GI:60280464, VRT 01 OCT. 2005 | HlyCfragm-gap-HCRF-Fxa-HCRF-HlyA1 | First set: 106 Second set: 108 | First set: 107 Second set: 109 | 110/111 | 112 |
| human interferon gamma, including Fx cleavage site | ACCESSION NP_000610 VERSION NP_000610.2 GI:56786138, PRI 02 OCT. 2011 | HlyCfragm-gap-hu IFN gamma-HlyA1 | 113 | 114 | 115/116 | 117 |
| murine IFN gamma, including Fx cleavage site | ACCESSION NP_032363 VERSION NP_032363.1 GI:33468859, ROD 02 OCT. 2011 | HlyCfragm-gap-mu IFN gamma-HlyA1 | 118 | 119 | 120/121 | 122 |
| nisin | ACCESSION P13068 VERSION P13068.1 GI:125973, BCT 03 MAY 2011 | HlyCfragm-gap-Nisin-HlyA1 | 128 | 129 | 130/131 | 132 |
| human Ifnar 1,2 (lacking the signal peptide) | ACCESSION AAH02590 VERSION AAH02590.1 GI:33876901, PRI 30 SEP. 2003 | HlyCfragm-gap-Ifnar 1,2-HlyA1 | 133 | 134 | 135/136 | 137 |
| human Ifnar 3,4 | ACCESSION P17181 VERSION P17181.3 GI:90110827, PRI 21 SEP. 2011 | HlyCfragm-gap-Ifnar 3,4-HlyA1 | 138 | 139 | 140/141 | 142 |
| IFABP | ACCESSION NP_037200 VERSION NP_037200.1 GI:6978827, ROD 14 AUG. 2011 | HlyCfragm-gap-IFABP-HlyA1 | 152 | 153 | 145/146 | 147 |

HlyCfragm-gap-HCRF-HCRF-HlyA1 was cloned using the following strategy: The synthetic gene was amplified with the oligonucleotides pSU-Hum.Corti_for and pSU-Hum.Corti2x_rev (SEQ ID NO:106 and 107). The pSU-Hum.Cortico vector comprising the construct HlyCfragm-gap-HCRF-HlyA1 was amplified and linearized by PCR with the oligonucleotides pSU-Cortico_lin_for and pSU HlyA1_lin_rev (SEQ ID NO:108 and 109). Gel extracted PCR products were used for the In-Fusion reaction.

The constructs IFABP G80V-HlyA1, IFABP G121V-HlyA1, IFABP G80V/G121V-HlyA1 were cloned starting from HlyCfragm-gap-IFABP-HlyA1 using standard mutagenesis protocols (cf. Quikchange mutagenesis protocol, Sambrook et al, (2001), supra). The resulting proteins were IFABP G80V-HlyA1, IFABP G121V-HlyA1, IFABP G80V/G121V-HlyA1 (SEQ ID Nos:148-150, respectively).

Example 8

Expression and Secretion of HlyA1-Fusion Proteins

E. coli BL21 (DE3), co-transformed with a HlyA1-fusion protein construct selected from the above table and pK184-HlyB,D, was grown in an expression culture, as detailed above.

Figure 7:
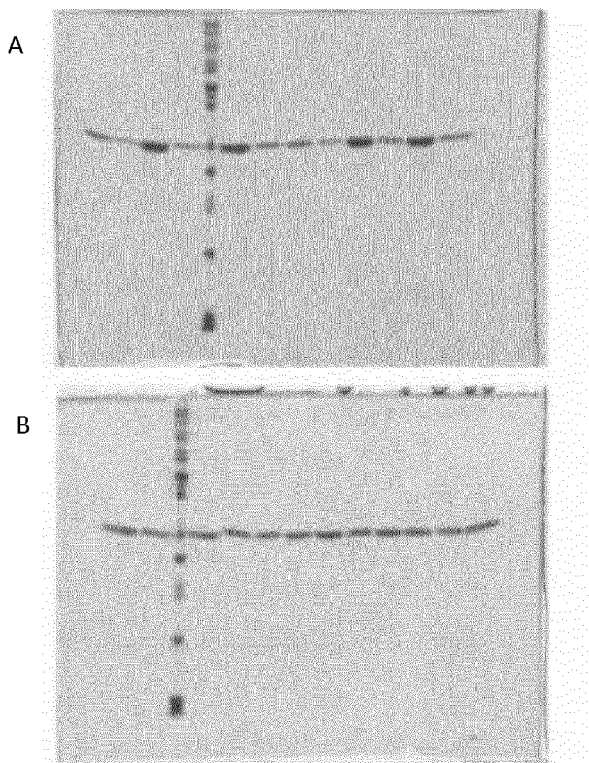
FIG. 7 shows two SDS-PAGE gels onto which 16 μl/lane cell culture supernatants were loaded. The supernatants loaded on the gel of FIG. 7A are derived from cultures of *E. coli* expressing Mab40-HlyA1 (SEQ ID NO:73) under varying conditions, whereas the supernatants loaded on the gel of FIG. 7B are derived from cultures of *E. coli* expressing Mab42-HlyA1 (SEQ ID NO:76).

In a first series of experiments constructs encoding for Mab40-HlyA1 and Mab42-HlyA1 fusion proteins were investigated. Several conditions were tested for each construct. After the expression and secretion was terminated, from each culture 16 µl/lane cell culture supernatant was loaded on an SDS-gel. FIG. 7A shows the results derived from cultures of E. coli expressing Mab40-HlyA1 (SEQ ID NO:73) under varying conditions, whereas the supernatants loaded on the gel of FIG. 7B were derived from cultures of E. coli expressing Mab42-HlyA1 (SEQ ID NO:76). Essentially, under all conditions tested the desired fusion proteins were expressed. Furthermore, both proteins could be successfully further purified using size-exclusion chromatography (data not shown).

Figure 8:
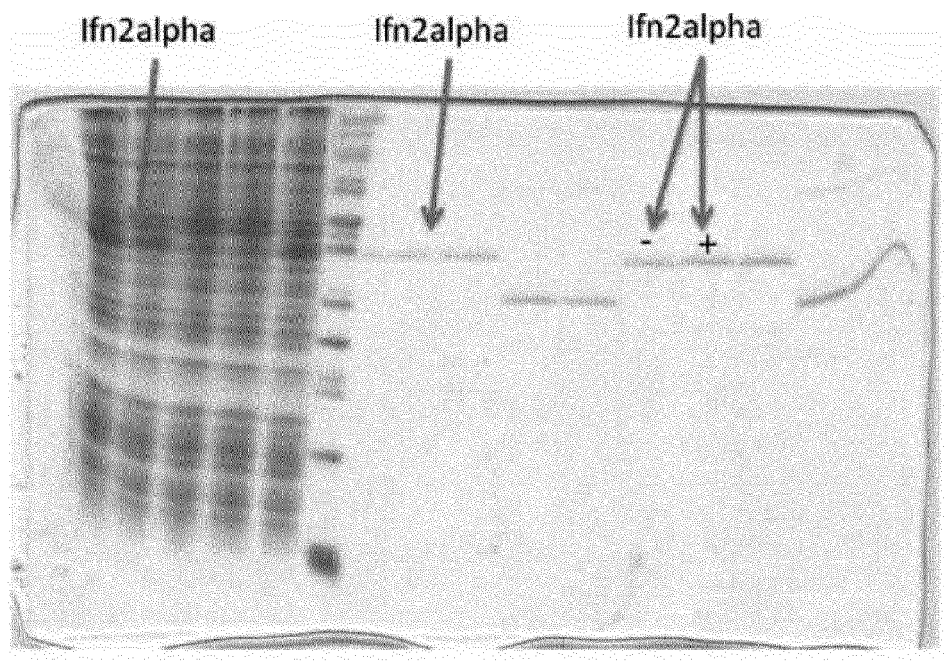
FIG. 8 shows an SDS-PAGE gel onto which either whole cells expressing interferon alpha 2 (lanes left from the molecular weight marker) or 16 μl/lane cell culture supernatants from the culture of these cells were loaded. The band labeled with "−" corresponds to interferon alpha 2-HlyA1 without a proteolytic cleavage site between Interferon alpha-2 and HlyA1, whereas the band labeled with "+" corresponds to interferon alpha 2-HlyA1 with a Factor Xa cleavage site between Interferon alpha-2 and HlyA1 (SEQ ID NO:127).

In the next step, two constructs encoding for an interferon alpha 2-HlyA1 fusion protein were analyzed. The first construct comprised a Factor Xa cleavage site between interferon alpha 2 and HlyA1, whereas this cleavage site was absent in the second construct. FIG. 8 shows an SDS-PAGE gel on which either whole cells expressing interferon alpha 2 (lanes on the left-hand side of the molecular weight marker) or 16 µl/lane cell culture supernatants were loaded. The band labeled with "−" corresponds to the interferon alpha 2-HlyA1 fusion protein lacking a proteolytic cleavage site between interferon alpha-2 and HlyA1, whereas the band labeled with "+" corresponds to interferon alpha 2-HlyA1 fusion protein comprising a Factor Xa cleavage site between interferon alpha-2 and HlyA1 (corresponding to the polypeptide sequence as set forth in SEQ ID NO:127).

Figure 9:
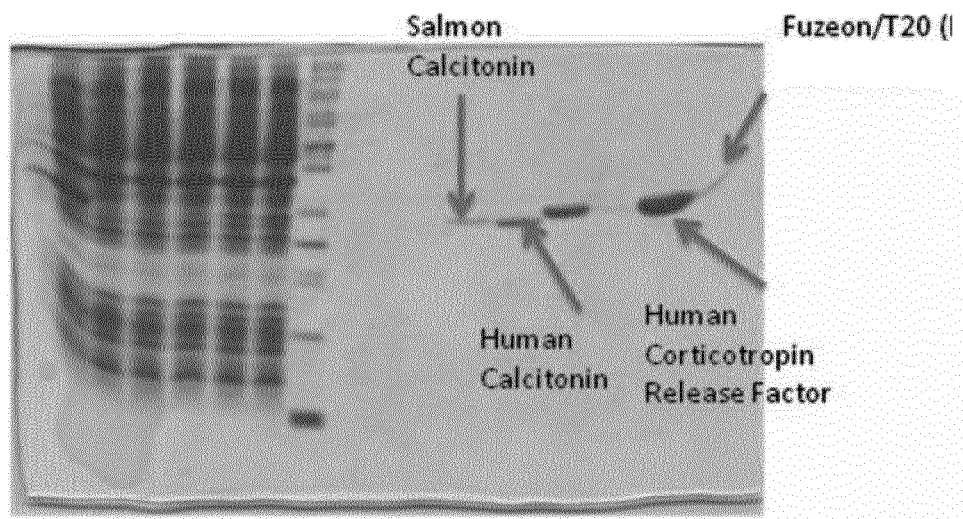
FIG. 9 shows an SDS-PAGE gel onto which either whole cells expressing different to-be-secreted proteins/peptides or the corresponding secreted proteins/proteins have been loaded, namely, salmon calcitonin, human calcitonin, human corticotropin release factor, and Fuzeon/T20 (SEQ ID NOs: 100, 95, 105, and 91). For each of human corticotropin release factor and Fuzeon/T20 samples from two expression cultures cultivated under different conditions have been loaded on the gel (four lanes on the right).
Figure 10:
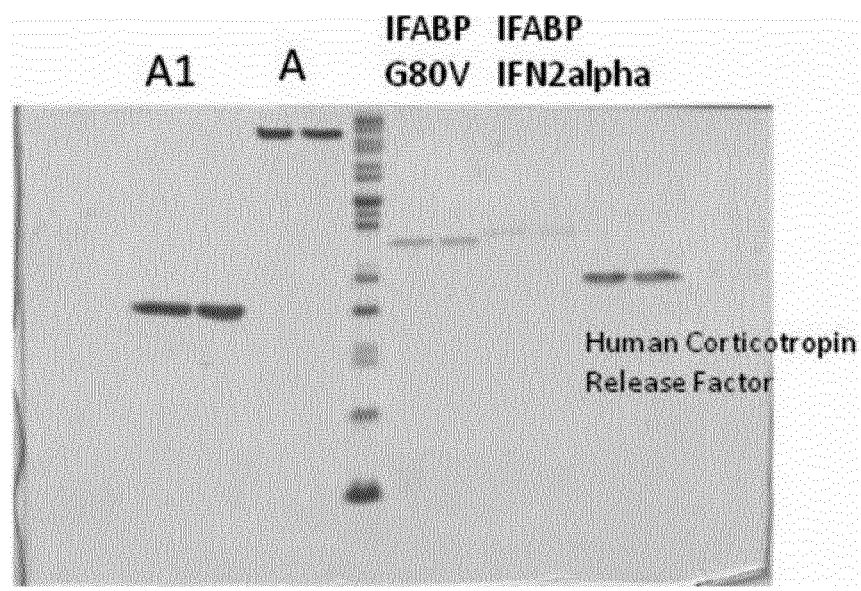
FIG. 10 shows an SDS-PAGE gel onto which different secreted proteins have been loaded, namely HlyA1, HlyA full length, and IFABP (G80V)-, interferon alpha-2-, and human corticotropin release factor-HlyA1 fusion proteins (SEQ ID NOs:46, 41, 148, 127, and 105, respectively).

In addition, the expression and secretion of further fusion proteins was analyzed. FIGS. 9 and 10 exemplarily show the successful expression of IFABP (G80V)-, IFABP-, human corticotropin release factor (HCRF)-, salmon calcitonin-, human calcitonin-, and Fuzeon/T20-HlyA1 fusion proteins (SEQ ID Nos. 148, 147, 105, 100, 95 and 91, respectively). Also, the CalB-, Zab3-, exenatide-, HCRF-FactorXa-HCRF-, human interferon gamma-, murine interferon gamma-, nisin-, Ifnar1,2-, Ifnar 3,4-, IFABP G121V-, and IFABP G80V/G121V-HlyA1 fusion proteins (SEQ ID Nos: 68, 81, 86, 112, 117, 122, 132, 137, 142, 149, and 150) were successfully expressed and secreted.

Example 9

Fold and Function of Recombinant Interferon Alpha-2-HlyA1

After expression and secretion of interferon alpha-2-HlyA1, using E. coli BL21 (DE3) cells carrying the plasmids pK184-HlyB,D and pSU-IFNalpha2+Xa cultivated in 200 ml 2YT medium, the cell-free supernatant was concentrated to about 2.2 ml. 2 ml were loaded onto a gel filtration column (Superdex 75 16/60) preequilibrated in buffer (10 mM Tris-HCl, 120 mM NaCl, 6 mM CaCl$_2$, pH 7.3) with a FPLC system (GE Healthcare). Elution fractions containing IFNalpha2-HlyA1 were pooled and concentrated via ultrafiltration (Amicon Filter Devices, Millipore) to 480 µL. The protein concentration was determined using a NanoDrop device (PeqLab), the calculated molecular mass (43.54 kDa), and extinction coefficient (40,590 M$^{-1}$ cm$^{-1}$) and found to be 6.41 mg/ml. This corresponds to a yield of about 15 mg/L of cell culture. 20 µl protein sample were diluted to 1 mg/ml in Dulbecco's Phosphate-buffered Saline (DPBS) (purchased without calcium and magnesium supplement) supplemented with 5 mM CaCl$_2$, and 1% FCS and stored at −80° C. until usage. In the next step, 30 µL Factor Xa (NEB) were added to the remaining 460 µL IFNalpha2 (6.41 mg/ml) and the mixture was incubated overnight at 20° C. IFNalpha2 was purified from uncleaved IFN2alpha-HlyA1, HlyA1 and Factor Xa using an anion exchange chromatography. IFNalpha 2 (19.84 kDa, 18,700 M$^{-1}$ cm$^{-1}$) eluted in the flow through and was concentrated via ultrafiltration to 0.46 mg/ml (corresponds to 1 mg/ml of IFNalpha2-HlyA1) and stored in DPBS supplemented with 5 mM CaCl$_2$ and 1% FCS at −80° C. until usage.

Figure 11:
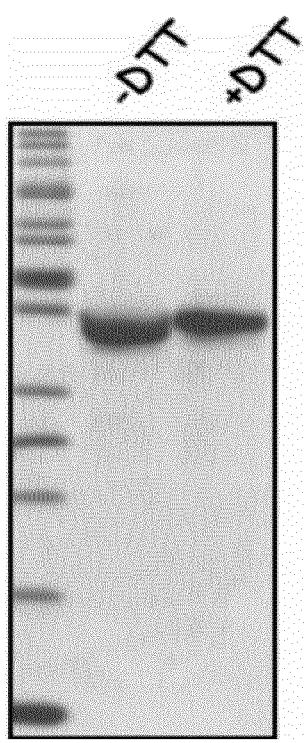
FIG. 11 shows an SDS-PAGE gel onto which molecular weight marker and secreted and purified interferon alpha-2-HlyA1 (SEQ ID NO:127) has been loaded. The interferon alpha-2-HlyA1 sample loaded on the lane labeled with "+DTT" has been treated with 50 mM DTT prior to the loading on the gel, whereas the sample loaded on lane "−DTT" has not been subjected to such treatment.

The native and also the recombinant interferon alpha 2 comprise four cysteine residues. Under native conditions, interferon alpha 2 comprises two cysteine-bridges. Therefore it was of interest to study whether the secreted protein also comprises functional disulphide-bridges. A previously published approach (Li et al., (2002) Protein Expr. Purif., 25(3):437-47) was followed by pre-incubating an aliquot of this protein with 50 mM DTT prior to its loading on an SDS-gel and comparing the migration of the protein with the corresponding non-reduced protein. The results shown in FIG. 11 indicate that the formation of cysteine-bridges occurs during the secretion process, as the migration of the protein slightly changes due to the pre-incubation with DTT. Therefore, it can be assumed that the secreted recombinant interferon alpha 2 still has its native fold.

To prove that the recombinant interferon alpha 2 is fully functional, two assays were carried out to study the biologic activity of the recombinant protein.

Figure 12:
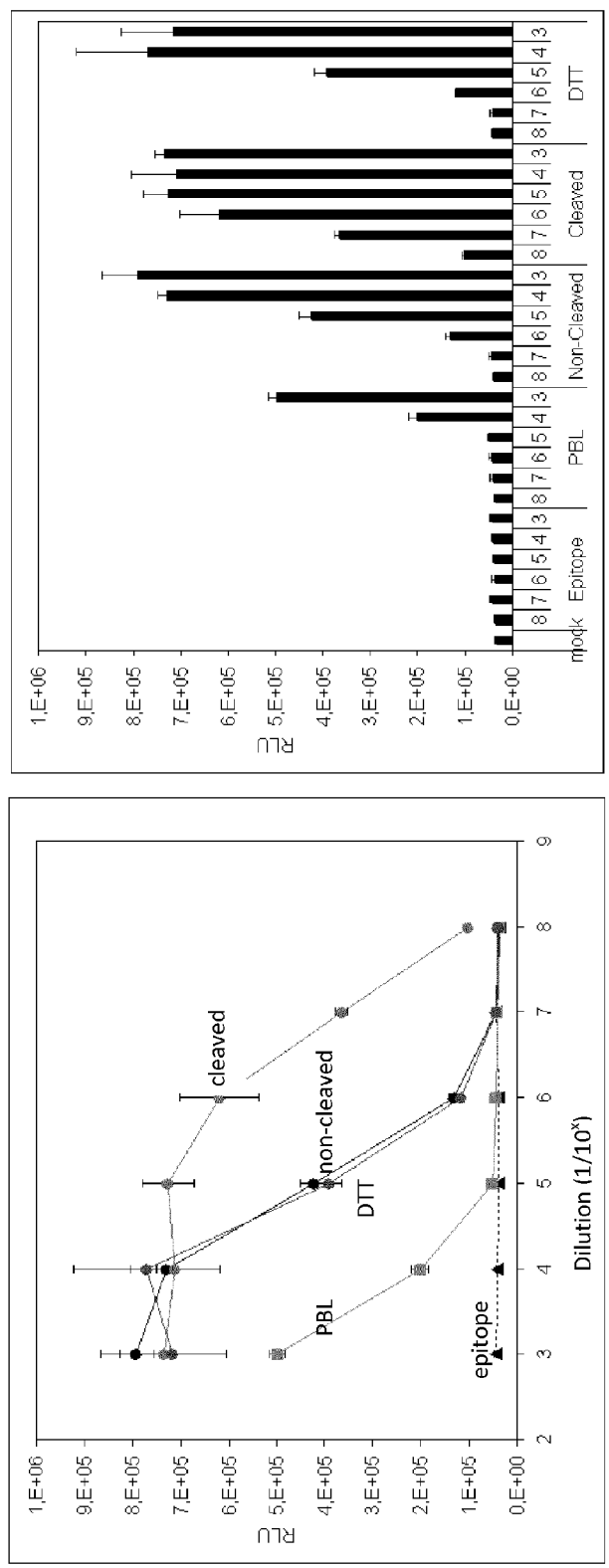
FIG. 12 shows the results of a biological assay to quantify the biologic activity of the recombinant human interferon alpha 2 using a clonal human retinal pigment epithelial (RPE) cell line, stably harboring an interferon stimulated response element (ISRE) promoter/enhancer in front of a firefly luciferase reporter gene. Commercially available rec-IFNa2 (PBL) served as a positive control and as a reference for the assessment of biologic activity. The diagrams show that for all dilutions tested the cleaved interferon alpha-2 produced by the method of the present invention exhibits the strongest biological activity. Surprisingly, non-cleaved interferon alpha-2-HlyA1 with or without additional DTT exhibited higher activities compared to the commercially available interferon alpha-2 (PBL).
Figure 13A:
FIG. 13 shows (A) schematic representation of the pSU-HlyA1 derivatives with truncated 5' elongations of hlyC and the gap regions (B) schematic representation of secretion constructs with variable length of the 5' elongation in front of the HlyA gene.
Figure 13A:
Figure 13A:
Figure 13A:
Figure 13A:
Figure 13A:
Figure 13A:
Figure 13A:
Figure 13A:
Figure 13A:
Figure 13A:
Figure 13A:
Figure 13B:
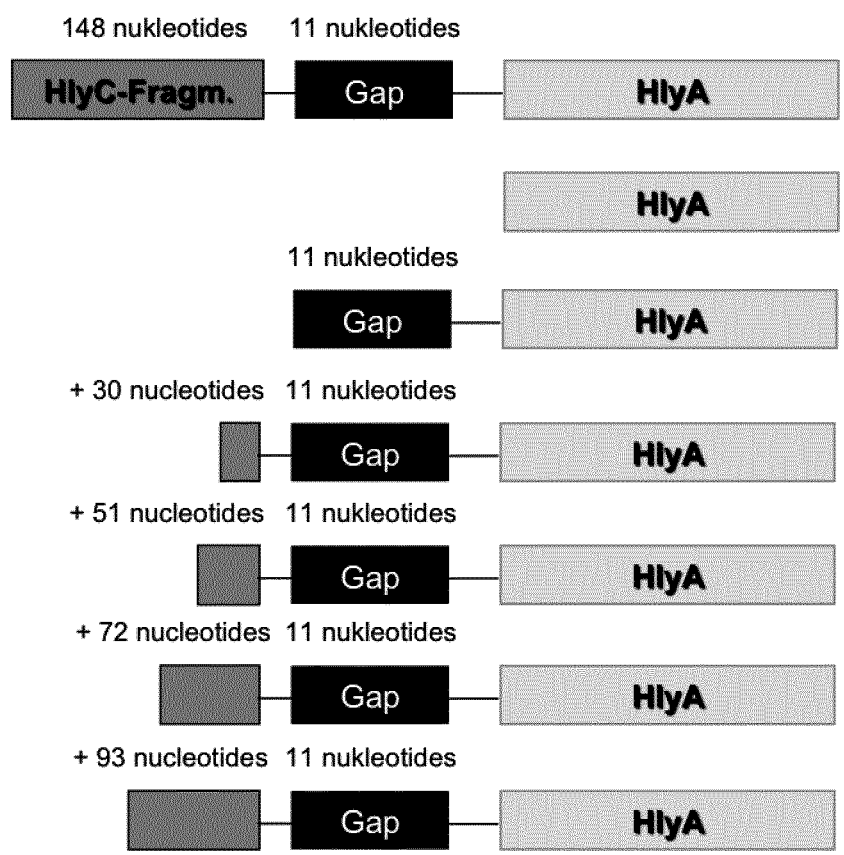

The first assay was based on the assessment of an interaction between recombinant interferon alpha 2 obtained after Factor Xa digestion (and thus without HlyA1) and anionic exchange chromatography, having a concentration of 0.46 mg/ml, with an interferon stimulated response element (ISRE). Therefore, a clonal human retinal pigment epithelial (RPE) cell line, stably harboring an interferon stimulated response element (ISRE) promoter/enhancer in front of a firefly luciferase reporter gene was used and the interaction of interferon alpha 2 with ISRE monitored by following a firefly luciferase catalyzed luminescence reaction, as the reporter cell line dose-dependently responds to treatment with type I IFN (IFN-α or IFN-β) with expression of luciferase (data not shown). In these experiments, cells were simultaneously seeded in 24-well plates, allowed to grow to confluency and incubated with the indicated grading dilutions of indicated recombinant protein preparations for 6 h @ 37° C. in 5% CO$_2$. Specifically, the cells were either treated with commercially available rec-IFNa2 from PBL (supplier) having an activity in undiluted state of 10$^5$ U/ml (PBL), which served as positive control, HlyA1 (Epitope), which served as negative control, Factor Xa cleaved and purified interferon alpha-2 (for the protocol see above), non-cleaved interferon alpha 2-HlyA1 (Non-cleaved, 1 mg/ml protein), and non-cleaved, DTT treated interferon alpha 2-HlyA1 (DTT, 1 mg/1 protein and 100 mM DTT). All compounds were tested in several dilutions ranging from 10$^{-3}$ to 10$^{-8}$. After the incubation was finished, the cells were lysed and the luciferase activity was measured using the luciferase reporter gene assay kit according to manufacturer's instructions (Roche, Mannheim, Germany) in a microplate luminometer (model Minthras LB940; Berthold Technologies). Each data point was determined in triplicate (n=3). Shown is the arithmetic mean value+/−standard deviation. FIG. 12 shows the results of this experiment. From this data the activity, for example for IFNalpha2, was calculated to be: $3.23+/-0.4*10^8$ U/ml. Thus, the interferon alpha 2 resulting from the method of the present invention is highly active. From both diagrams of FIG. 12 it can be concluded that for all dilutions tested the cleaved interferon alpha-2 produced by the method of the present invention exhibited the strongest biological activity. Also non-cleaved interferon alpha-2-HlyA1 and non-cleaved, DTT-treated interferon alpha-2-HlyA1 exhibited higher activities compared to commercially available interferon alpha-2 (PBL).

In the second assay the interferon alpha 2 activity was assessed by analyzing the antiviral potency of the peptide or protein. Specifically, the antiviral effect of interferon alpha-2 was analyzed by pre-incubating human MRC-5 lung fibroblasts (ATCC CCL-171) for 24 h with the indicated dilution of the recombinant protein and afterwards infected with the indicated PFU/well of rhabdovirus vesicular stomatitis virus (VSV). 2 days post infection living cells were stained with crystal violet (0.05% [w/v] in 20% [v/v] ethanol) to counterstain and visualize the cytolytic effect of VSV. As in the previous assay, commercially available rec-IFNa2 (PBL) served as positive control and HlyA1 (epitope) as negative control for the assessment the biologic activity. Furthermore, non-cleaved interferon alpha-2-HlyA1 and non-cleaved, DTT-treated interferon alpha-2-HlyA1 were assessed. All compounds were tested in several dilutions. Under all conditions tested, the Factor Xa cleaved and purified interferon alpha-2 produced by the method of the present invention exhibited the strongest antiviral biological activity. Non-cleaved interferon alpha 2-HlyA1 and DTT treated, non-cleaved interferon alpha 2-HlyA1 showed a similar activity, which was significantly stronger than the commercially available interferon alpha 2 (data not shown).

Example 10

Analysis of HlyC/Gap Fragments

As demonstrated in Example 3, the presence of a fragment of the HlyC encoding sequence+the so-called gap sequence (148 3"-terminal nt of the HlyC gene+11 nt long gap sequence; SEQ ID NO:12) in the expression construct could beneficially affect the expression and secretion of HlyA1 (SEQ ID NO:46). To further investigate the influence of this sequence on the expression, additional constructs comprising fragments of the sequence of SEQ ID NO:12 were designed. For this, the parental plasmid pSU-HlyA1 (SEQ ID NO:63) was amplified with oligonucleotides at the desired positions and ligated. Comparable experiments were carried out by using pSU-HlyA full length (SEQ ID NO:62) encoding full length HlyA (SEQ ID NO:41) instead of HlyA1 (SEQ ID NO:46).

The plasmids pSU-HlyA1 (SEQ ID NO:63) and pSU-HlyA full length (SEQ ID NO:62) were used as templates. For the 5" HlyC fragment truncations, the following primer oligonucleotides were used in a PCR Reaction (all phosphorylated at the 5' end, ordered at MWG Eurofins):

```
Reverse:
A1minC_Pi_rev:
                                        (SEQ ID NO: 162)
GCTCGAATTCGTAATCATG (the same for all constructs)

Forward:
a) Gap5_11_Pi_for:
                                        (SEQ ID NO: 163)
ATTAAATGGGAAATTCTCTTGC b) Gap8_11_Pi_for:
                                        (SEQ ID NO: 164)
GTAATTAAATGGGAAATTCTCTTG c) Gap + 6_Pi_for:
                                        (SEQ ID NO: 165)
GGTTAAGAGGTAATTAAATGGG d) Gap + 12_Pi_for:
                                        (SEQ ID NO: 166)
TTAACTGGTTAAGAGGTAATTAAATG e) Gap + 21_Pi_for:
                                        (SEQ ID NO: 167)
AATTTTTCATTAACTGGTTAAGAG f) Gap + 30_Pi_for:
                                        (SEQ ID NO: 168)
TCAGATTTTAATTTTTCATTAACTGG g) Gap + 51_Pi_for:
                                        (SEQ ID NO: 169)
ATAACTGAAGTAAAAAGAAAGTCA h) Gap + 72_Pi_for:
                                        (SEQ ID NO: 170)
AAACAATATCACCACGAGTTA i) Gap + 93_Pi_for:
                                        (SEQ ID NO: 171)
CAGTTAGCGAATAAAATTTTTAAAC
```

Moreover, in the pSU-HlyAfull length vector (SEQ ID NO:62) the lac promotor was deleted to investigate whether the 5' HlyC elongation is sufficient for the expression and secretion and if it represents an independent promotor. For the deletion of the lac promoter the following primers were used:

```
Forward:
MinLaPro_Pi_for:
                                        (SEQ ID NO: 172)
ATGATTACGAATTCGAGCTCCCAA Reverse:
MinLaPro_Pi_rev:
                                        (SEQ ID NO: 173)
CCAACGCGCGGGGA
```

The constructs comprising a deletion of the HlyC fragment comprised an additional in-frame ATG codon that was removed by mutation to avoid the presence of additional amino acids on the N-terminus of the protein. The mutation oligonucleotide primers (non-phosphorylated) had the sequence:

```
Del_ATG_minC_for:
                                        (SEQ ID NO: 174)
CAGGAAACAGCTATGACATTATTACGAATTCGAGCATGG Del_ATG_minC_rev:
                                        (SEQ ID NO: 175)
CCATGCTCGAATTCGTAATAATGTCATAGCTGTTTCCTG
``` pSU-HlyA1 was amplified with the oligonucleotide A1minC_Pi_rev in combination with each of the "forward"

oligonucleotides. pSU-HlyAfull was amplified for the truncation of the 5' elongation with the oligonucleotides already used for pSU-HlyA1 with the exception of pSU-HlyAfull minC and pSU-HlyAfull+gap for which the following forward oligonucleotide primers were used:

```
AfullminC_Pi_for:
                                    (SEQ ID NO: 337)
ATGACAACAATAACCACTGC Afull_ + Gap_Pi_for:
                                    (SEQ ID NO: 338)
GAGGTAATTAAATGACAACAATAAC
```

The oligonucleotides "MinLaPro_Pi_for" and "MinLaPro_Pi_rev" were used to remove the lac Promotor. The PCR products were digested with DpnI to inactivate the template DNA, gel-extracted and 50 ng linearized plasmids were ligated overnight at 4° C. Ligation samples were used for transformations of chemically competent E. coli DH5α cells and the plasmids were isolated of grown colonies. All plasmids were verified by sequencing.

The construct pSU-HlyA1 minus HlyC was already used for secretion studies, and a small protein signal in the supernatant of cell cultures could be detected by CBB staining (see FIG. 4A, lane 6 and 7). However, the protein runs slightly above the others, indicating a higher molecular mass. In this construct, the deletion of the 5' HlyC elongation shifted the reading frame and a new in-frame start codon was created resulting in HlyA1 plus 6 additional N-terminal amino acids. Thus, the oligonucleotides Del_ATG_minC_for and Del_ATG_minCrev in combination with the site-directed mutagenesis kit (Stratagene) were used to mutate the artificial start-codon. The new plasmid was called "pSU-HlyA1 minus HlyC ΔATG" and the insertion of the mutation was verified by sequencing.

The following plasmids were generated: pSU-HlyA1 (SEQ ID NO:63), pSU-HlyA1 minus HlyC (SEQ ID NO:176), pSU-HlyA1 minus HlyC ΔATG (SEQ ID NO:177), pSU-HlyA1 5/11 gap (SEQ ID NO:178), pSU-HlyA1 8/11 gap (SEQ ID NO:179), pSU-HlyA1+gap (SEQ ID NO:180), pSU-HlyA1+gap+6 (SEQ ID NO:181), pSU-HlyA1+gap+12 (SEQ ID NO:182), pSU-HlyA1+gap+21 (SEQ ID NO:183), pSU-HlyA1+gap+30 (SEQ ID NO:184), pSU-HlyA1+gap+51 (SEQ ID NO:185), pSU-HlyA1+gap+72 (SEQ ID NO:186), pSU-HlyA1+gap+93 (SEQ ID NO:187), pSU-HlyA full (SEQ ID NO:62), pSU-HlyA full minC (SEQ ID NO:188), pSU-HlyA full+gap (SEQ ID NO:189), pSU-HlyA full+30 (SEQ ID NO:190), pSU-HlyA full+51 (SEQ ID NO:191), pSU-HlyA full+72 (SEQ ID NO:192), pSU-HlyA full+93 (SEQ ID NO:193), and pSU-HlyA full minus lac Promoter (SEQ ID NO:194).

Figure 14:
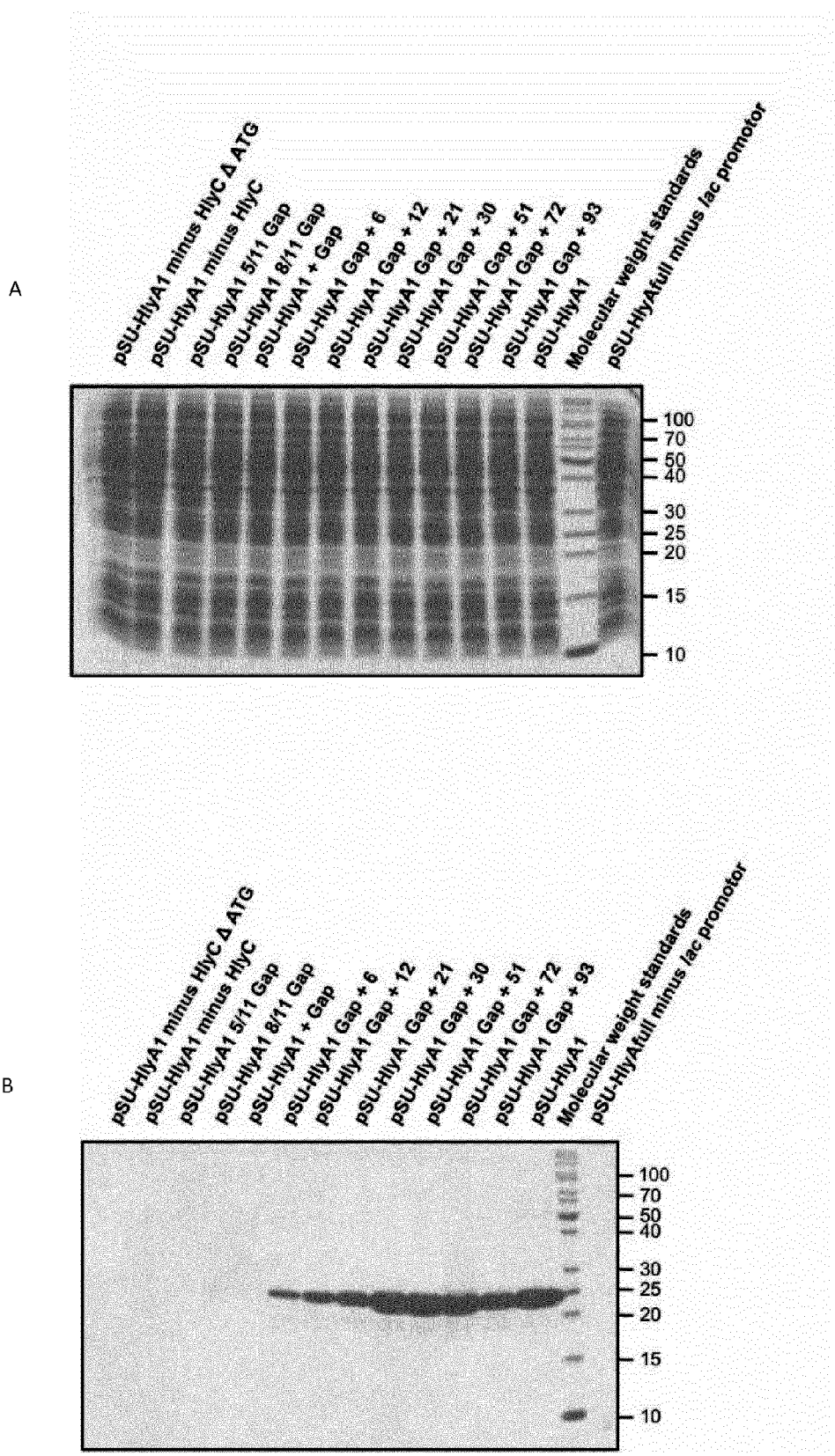
FIG. 14 shows a (A) secretion analysis pSJ37 HlyB/D and pSU-HlyA1 5' truncations; cell lysates; (B) secretion analysis pSJ37 HlyB/D and pSU-HlyA1 5' truncations; supernatant samples
Figure 15:
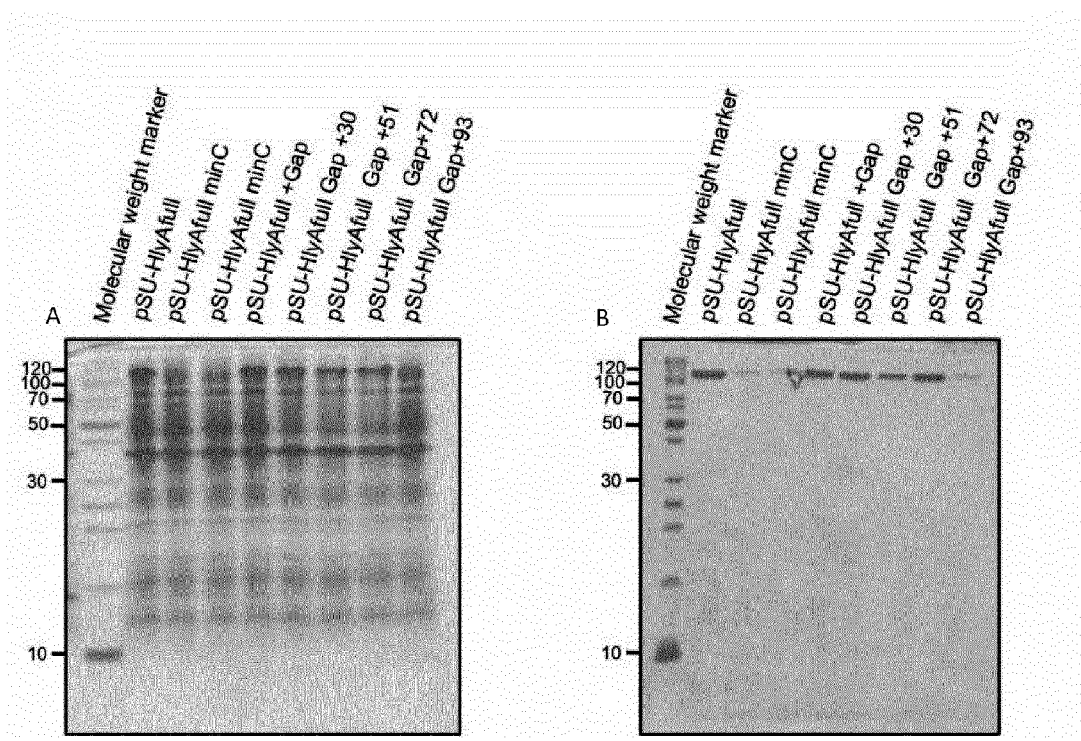
FIG. 15 shows a secretion analysis with pSU-HlyAfull plasmids with truncated 5' elongations. (A) cell lysates; (B) cell supernatants.

FIGS. 13 A and B schematically illustrate the various inserts in the pSU vector. E. coli DH5α cells were transformed with the different constructs and pSJ37 HlyB/D and the respective proteins expressed and secreted, as detailed above. The results of these experiments are depicted in FIGS. 14A and B (HlyA1) and FIGS. 15 A and B (HlyA full length). The 5' HlyC elongation of hlyA1 has a drastic effect on the expression and secretion levels of HlyA1 (14). This elongation encodes for the last 148 nucleotides of the 3' part of hlyC and 11 intergenetic nucleotides (Gap) between hlyC and hlyA1, however, this sequence is not translated. The highest expression and secretion levels are obtained with the constructs pSU-HlyA1 Gap+30/+51/+72 and pSU-HlyA1. Nevertheless, as the expression and secretion levels can be controlled by variations of the 5' elongation, other constructs might be beneficial in some cases.

The promotor, in this case a lac promotor, is an essential element of the plasmid pSU-HlyAfull for the expression and secretion of HlyA.

FIG. 14A shows an SDS-Page of cell lysates, FIG. 14B shows an SDS-Page of the supernatants.

HlyAfull (110 kDa) is secreted in high yields with the invented secretion system in yields of up to 600 mg per liter cell culture. The truncation of the 5' elongation in front of hlyA consisting of a fragment of hlyC and the gap reduced the secretion levels drastically. The addition of the gap, gap+30, gap+51 and gap+72 recovered the secretion of HlyAfull to about the same level as with the pSU-HlyAfull plasmid. (FIG. 15A: cell lysates; FIG. 15B: cell supernatant).

As shown above, the 5' elongation in front of the genes encoding the secreted proteins—of interest is very important for their expression. Since the 5' elongation corresponds to the gene of HlyC, a protein being part of the Hly Operon in E. coli, it was next investigated, whether the insertion of the entire HlyC gene in front of the secretion constructs influences the secretion levels. The generated plasmid pSU-HlyC-HlyA1 was subsequently truncated by 5' parts of the HlyC gene.

As a template pSU-HlyA1 (SEQ ID NO:63) and a synthetic gene of HlyC (GenScript), which corresponds to the hlyC gene of plasmid pHly152 were used. The full length hlyC gene had the nucleotide sequence set forth in SEQ ID NO:195 and the corresponding HlyC protein the amino acid sequence set forth in SEQ ID NO:196.

For the amplification and cloning procedure the following oligonucleotides were used:

Linearization and Amplification of pSU-HlyA1:

```
a) pSU-A1 + Gap_lin_for:
                                    (SEQ ID NO: 197)
   GAGGTAATTAAATGGGAAATTCTC b) A1minC_lin_rev:
                                    (SEQ ID NO: 198)
   GCTCGAATTCGTAATCATG
```

Amplification of the HlyC Gene:

```
a) HlyC_inpSU_for:
                                    (SEQ ID NO: 199)
   ATTACGAATTCGAGCATGAATATAAACAAACCATTAGAGAT b) HlyC_befGap_rev:
                                    (SEQ ID NO: 200)
   CCATTTAATTACCTCTTAACCAGTTAATGAAAAATTAAAATC
```

5' Truncations of pSU-HlyC-HlyA1:

```
a) A1minC_lin_rev:
                                    (SEQ ID NO: 201)
   GCTCGAATTCGTAATCATG b) pSU-511_A1_for:
                                    (SEQ ID NO: 202)
   GAATATAAACAAACCATTAGAGATTC c) pSU-448_A1_for:
                                    (SEQ ID NO: 203)
```

-continued

ACACAGAAACTGGCCA d) pSU-388_A1_for:
(SEQ ID NO: 204)
CCAATATGTTTTATTAACCCGG e) pSU-328_A1_for:
(SEQ ID NO: 205)
AAGTTTAGAAAATGAAATTAAATATCTTAAT f) pSU-268_A1_for:
(SEQ ID NO: 206)
GACTTCAGGTGATCGTAAAT g) pSU-208_A1_for:
(SEQ ID NO: 207)
CCTGTACAAATATATGCGAAAAA Site-Directed Mutagenesis of Artificial Start-Codon a) HlyCA1_DelATG_for:
(SEQ ID NO: 208)
GAAACAGCTATGACATTATTACGAATTCGAGCATG b) HlyCA1_DelATG_rev:
(SEQ ID NO: 209)
CATGCTCGAATTCGTAATAATGTCATAGCTGTTTC pSU-HlyA1 was linearized and amplified with the oligonucleotides pSU-A1+Gap_lin_for and A1minC_lin_rev. The HlyC gene was amplified with the oligonucleotides HlyC_inpSU_for and HlyC_befGap_rev carrying 15 nucleotides-long overhangs (see above) for the subsequent In-Fusion reaction. The In-Fusion reaction was performed with the In-Fusion HD Cloning Kit (ClonTech) as described in the manual. E. coli DH5α, XL1 or similar strains were transformed with the In-Fusion reaction, plated on LB agar plates containing the desired antibiotic and the plasmids were isolated from single colonies with well-known methods. The plasmid pSU-HlyC-HlyA1 was verified by sequencing.

Mutagenesis was performed either with the Site-Directed Mutagenesis Kit (Stratagene) according to the manual or manually using well-known strategies including PCR with complement oligonucleotides carrying the desired mutation, DpnI digest of the template DNA and subsequent transformation of chemically competent E. coli cells and plasmid preparation of grown colonies.

pSU-HlyC-HlyA1 was amplified with the phosphorylated oligonucleotide A1minC_lin_rev in combination with each of the "forward" oligonucleotides. PCR products were digested with DpnI, gel-extracted and 50 ng linearized plasmids were ligated overnight at 4° C. Ligated plasmids were used for transformations of chemically competent E. coli DH5α cells. All plasmids were isolated and verified by sequencing.

The construct pSU-HlyA1 minus HlyC was already used for secretion studies, and a small protein signal in the supernatant of cell cultures could be detected by CBB staining (see FIG. 4A, lane 6 and 7 in the patent application). However, the protein run slightly above the others, indicating a higher molecular mass. In this construct, the deletion of the 5' HlyC elongation shifted the reading frame and a new in-frame start codon was created resulting in HlyA1 plus 6 additional N-terminal amino acids. The same shift of the reading frame occurred in the plasmid pSU-HlyC-HlyA1. Thus, the oligonucleotides HlyCA1_DelATG_for and HlyCA1_DelATG_rev were used to mutate the artificial start-codon. The new plasmid was called "pSU-HlyC-HlyA1 ΔATG" and the insertion of the mutation was verified by sequencing.

The following plasmids were generated which contain the entire gene of HlyC in front of the Gap and hlyA1 or truncated hlyC genes.

pSU-HlyC-HlyA1 (SEQ ID NO:210), pSU-HlyC-HlyA1 ΔATG (SEQ ID NO:211), pSU-HlyA1 Gap+511 (SEQ ID NO:212), pSU-HlyA1 Gap+448 (SEQ ID NO:213), pSU-HlyA1 Gap+388 (SEQ ID NO:214), pSU-HlyA1 Gap+328 (SEQ ID NO:215), pSU-HlyA1 Gap+268 (SEQ ID NO:216), and pSU-HlyA1 Gap+208 (SEQ ID NO:217).

Figure 16:
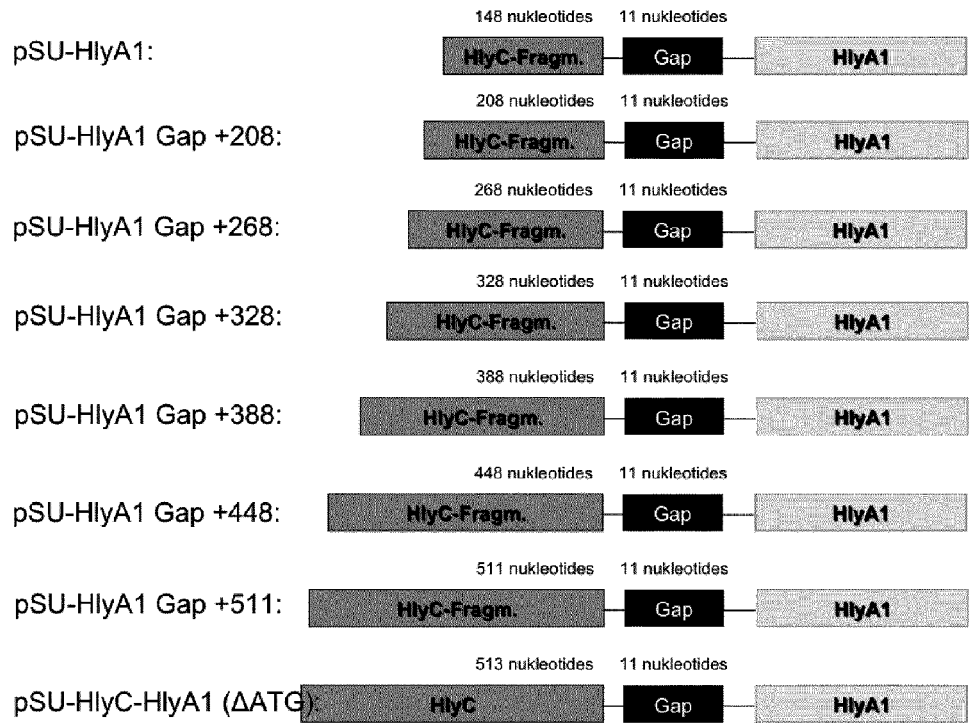
FIG. 16 shows a schematic representation of the pSU-HlyA1 derivatives with elongated 5' regions of hlyC and the gap region.

FIG. 16 schematically illustrates the various inserts in the pSU vector.

Expression and secretion experiments were carried out similar to those described above and the results are shown in FIGS. 17 A (cell supernatants) and B (cell lysates).

Figure 17:
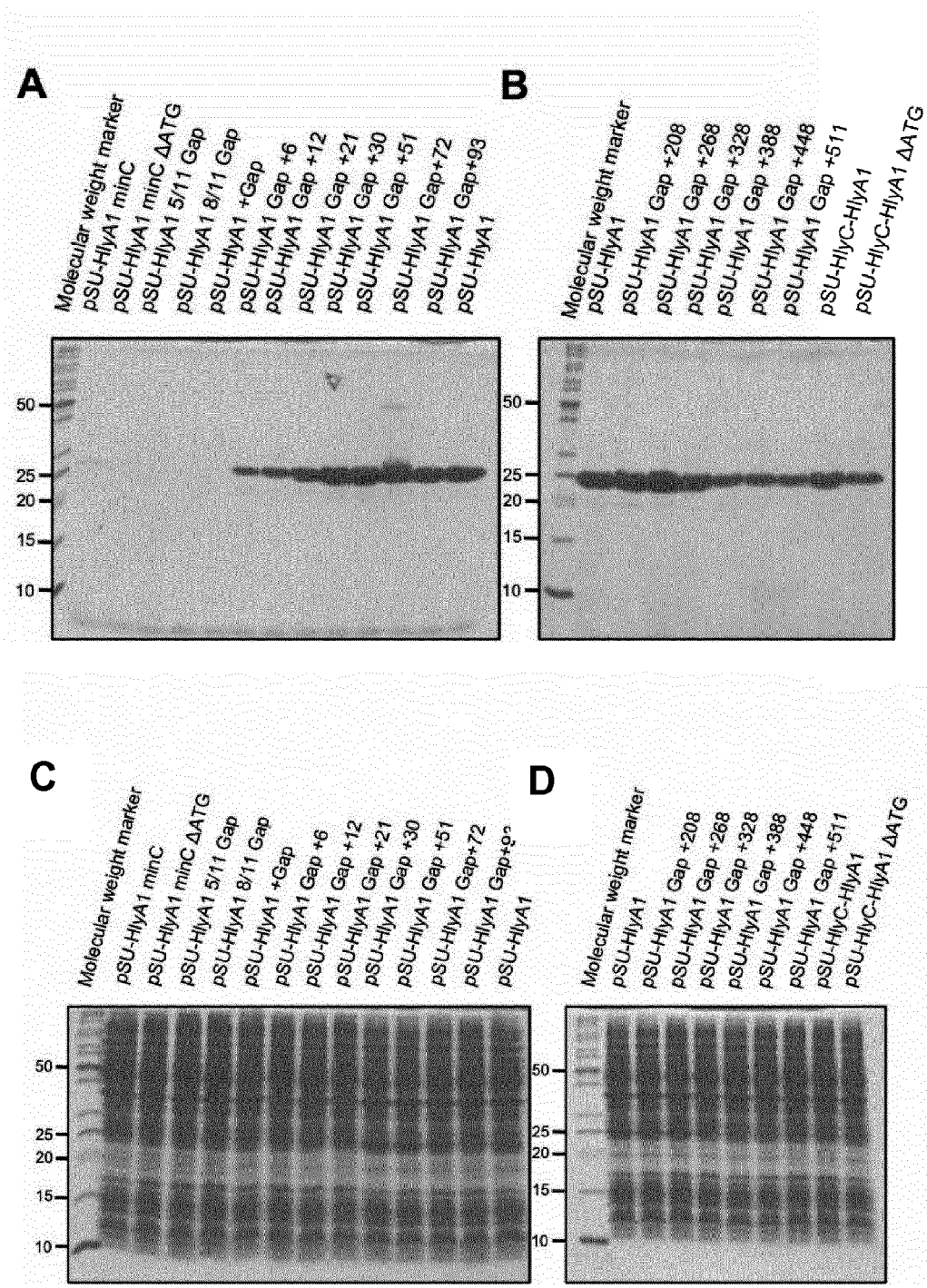
FIG. 17 shows a secretion analysis of HlyA1 with derivatives of pSU-HlyA1. (A) The 5' elongation in front of hlyA1 consisting of the gap and parts of hlyC was truncated stepwise and the secretion levels of HlyA1 were analyzed; (B) In comparison to A, the 5' elongation in front of hlyA1 was stepwise elongated by the missing parts of hlyC and the secretion levels were analyzed. Shown are CBB stained SDS-PAGE gels of supernatant samples of the cell culture after the secretion experiments. (C) and (D) show the corresponding CBB stained SDS-PAGE gels of cell lysate samples after the secretion experiments.

The huge impact of the 5' elongation of hlyA1 by the gap and hlyC demonstrated above is shown again in FIGS. 17A and C. In addition to the truncations, hlyC was elongated stepwise until the entire hlyC was inserted in front of the gap and hlyA1. The results of the corresponding secretion analysis are shown in FIGS. 17 B and D. The maximum secretion levels of HlyA1 were obtained with plasmids pSU-HlyA1 Gap+30, pSU-HlyA1 Gap+51, pSU-HlyA1 Gap+72, pSU-HlyA1, pSU-HlyA1 Gap+208 and pSU-HlyA1 Gap+268 reaching about 1 g HlyA1/liter culture medium.

The results further show that despite the truncations and elongations of the 5' non-translated region on pSU-HlyA1 in front of hlyA1, a protein with an identical molecular weight is secreted, namely HlyA1 (however, with very different yields). This means that the translation starts always at the same start codon independently of the inserted/deleted sequences. Without wishing to be bound to any particular theory, one explanation for this may be an altered transcription efficiency of the gene, an altered mRNA stability, increased translation rates of the mRNA or other altered characteristics of the expression system.

Example 11

Construction and Expression of Various HlyA1 Fusion Proteins

Secretion experiments were carried out with maltose binding protein (MBP), *Candida antarctica* Lipase B (CalB), IFNα2, IFNy, IFABP G121V, Zab3, Nisin, HCRF, Mab40, Fuzeon, and HCRF/2×HCRF, cloned and expressed as detailed in Examples 7 and 8 above. The resulting cell lysates and cell supernatants were analyzed by SDS-PAGE with the results shown in FIGS. 18 A and B. Asterisks indicate the secreted HlyA1-fusion proteins. The lanes left from the marker are the cell lysates and the lanes right from the marker are the cell supernatants.

MBP 50 mL cultures of *E. coli* cells carrying pK184-HlyB,D (see above) and pSU-MBP were induced at an $OD_{600}$ of 0.5 with 1 mM IPTG and grown for additional 6 h. Cultures were centrifuged (20 min, 50.000×g, 4° C.) and 25 mL supernatant was loaded on amylose resin (NEB) pre-equilibrated in buffer (20 mM HEPES, 150 mM NaCl, 5 mM $CaCl_2$, pH 7.4) by gravity flow. The column was washed thoroughly with the same buffer and the MBP fusion protein was eluted with buffer containing 10 mM maltose. It was found that MBP-HlyA1 is secreted in the culture supernatant (FIG. 18), is biological active in binding to immobilized amylose and is eluted from the resin by maltose (data not shown).

Figure 18:
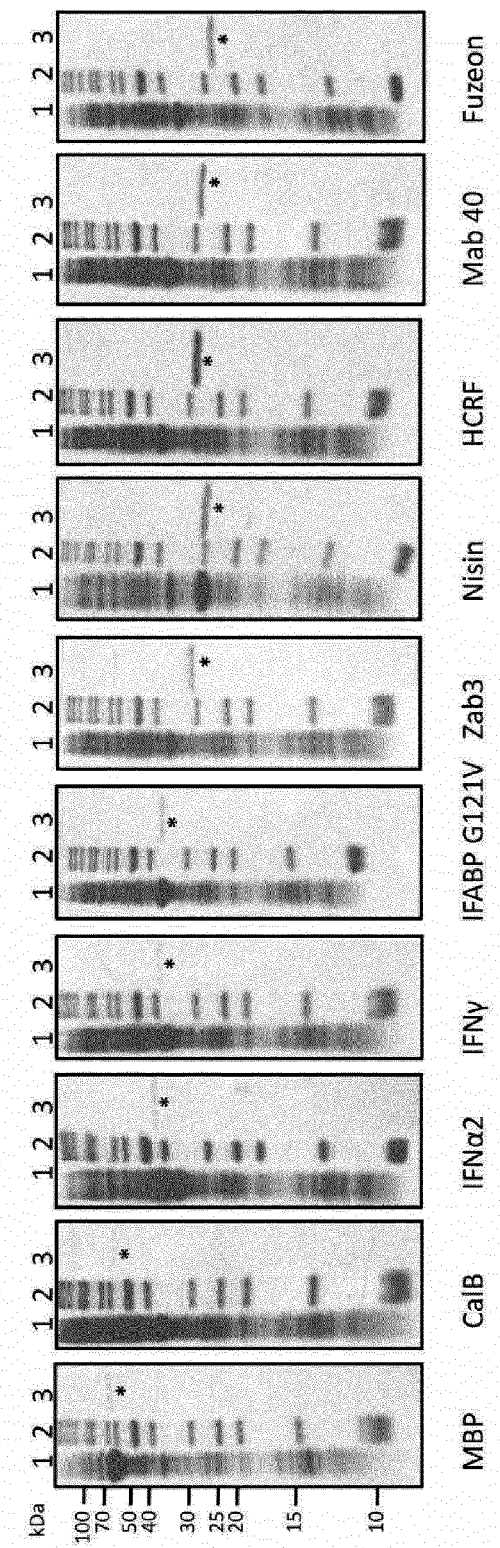
FIG. 18 shows the SDS-PAGE analysis of various secretion experiments with the indicated proteins. Shown are cell lysate and supernatant samples after the secretion experiments. * indicates the position of secreted proteins.

CalB 15 mL liquid LB agar (1.5%) was emulsified with 1% glycerol tributyrate (Fluka) by sonication and supplemented with 1 mM IPTG and the appropriate antibiotics (GT plates). E. coli BL21 (DE3) cells were transformed with either pK184-HlyBD, pSU-CalB or both plasmids and grown on GT plates for 36 h at 37° C. CalB is secreted with the invented system (FIG. 18). The lipolytic activity of secreted CalB-HlyA1 was investigated with a plate agar test. Here, a substrate of lipases (tributyrin-glycerol) was emulsified in LB agar and cells were grown on such plates. Only cells carrying both plasmids, pSU-CalB and pK184-HlyBD, formed halos. These results demonstrate that 1.) CalB-HlyA1 is secreted out of the cells into the exterior and 2.) CalB is biological active even as fusion protein with HlyA1.

LipA

All growth media contained kanamycin (30 µg/mL) and ampicillin (100 µg/mL). For secretion experiments 2×YT medium supplemented with 5 mM $CaCl_2$ was used. 50 mL cultures of cells carrying pK184-HlyBD and pSU-LipA were grown with a start $OD_{600}$ of 0.1 at 37° C. and 160 rpm. The expression was induced with 1 mM IPTG at an $OD_{600}$ of 0.4-0.6 for 6 h. Cultures were centrifuged (20 min, 50.000×g, 4° C.) and supernatant samples (16 µL) and cells (ODeq=0.08) were analyzed by SDS-PAGE and Coomassie Brilliant Blue (CBB) staining 10 mL liquid LB agar (1.0%) was emulsified with 1% glycerol tributyrate (Fluka) by sonication and supplemented either with 5 mM $CaCl_2$ or with 5 mM $CaCL_2$ in combination with 1 mM IPTG and the appropriate antibiotics. E. coli BL21 (DE3) cells were transformed with either pSU-LipA alone or pSU-LipA and pK184-HlyBD and grown on the agar plates for 18 h at 37° C. It was found that LipA is secreted with the invented secretion system and that the secreted LipA is lipolytically active (data not shown).

SprP

All growth media contained kanamycin (30 µg/mL) and ampicillin (100 µg/mL). For secretion experiments 2×YT medium supplemented with 5 mM $CaCl_2$ was used. 50 mL cultures of cells carrying pK184-HlyBD and pSU-SprP-minLS were grown with a start $OD_{600}$ of 0.1 at 37° C. and 160 rpm. The expression was induced with 1 mM IPTG at an $OD_{600}$ of 0.4-0.6 for 6 h. Cultures were centrifuged (20 min, 50.000×g, 4° C.) and supernatant samples (16 µL) and cells (ODeq=0.08) were analyzed by SDS-PAGE and Coomassie Brilliant Blue (CBB) staining 100 mL supernatant was concentrated to ~2 mL by ultrafiltration (Amicon filter device, 50 kDa MWCO). The concentrate was purified by size-exclusion chromatography (Superdex 200 16/60, GE Healthcare) equilibrated in SEC buffer (10 mM Tris-HCl, 120 mM NaCl, 5 mM $Ca_2Cl$, pH 7.3) using a FPLC system (GE Healthcare). Desired elution fractions were concentrated by ultrafiltration. SprP is assumed to be a protease, however, it could not be produced and analyzed until now. A colometrical assay was applied to investigate a potential proteolytic activity of secreted SprP with the colourless substrate Nα-Benzoyl-D,L-arginine 4-nitroanilide hydrochloride (Sigma-Aldrich). If secreted SprP proteolytically cleaves the substrate, a yellow product is formed, which can be subsequently detected by UV-VIS spectroscopy. It was shown that secreted SprP cleaves the substrate and produces the yellow product (data not shown). Therefore, SprP is a protease and is secreted in an active form with the secretion system described herein. SprP minLS is secreted with the invented system. An N-terminal truncated version of SprP (SprP_ORF2) is also secreted. Moreover, SprPminLS with an N-terminal or C-terminal his-tag in combination with site-specific protease cleavage sites are secreted. Computational analyses classify SprP as serine protease and a potential catalytic activity of SprP was investigated. It could be shown that SprP is a protease and is secreted in an active form with the invented system (data not shown).

Vif

All growth media contained kanamycin (30 µg/mL) and ampicillin (100 µg/mL). For secretion experiments 2×YT medium supplemented with 5 mM $CaCl_2$ was used. 50 mL cultures of cells carrying pK184-HlyBD and pSU-Vif were grown with a start $OD_{600}$ of 0.1 at 37° C. and 160 rpm. The expression was induced with 1 mM IPTG at an $OD_{600}$ of 0.4-0.6 for 6 h. Cultures were centrifuged (20 min, 50.000× g, 4° C.) and supernatant samples (16 µL) and cells (ODeq=0.08) were analyzed by SDS-PAGE and Coomassie Brilliant Blue (CBB) staining 100 mL supernatant was concentrated to ~2 mL by ultrafiltration (Amicon filter device, 50 kDa MWCO). The concentrate was purified by size-exclusion chromatography (Superdex 200 16/60, GE Healthcare) equilibrated in SEC buffer (10 mM Tris-HCl, 120 mM NaCl, 5 mM $Ca_2Cl$, pH 7.3) using a FPLC system (GE Healthcare). Desired elution fractions were concentrated by ultrafiltration. Secreted Vif was proteolytically cleaved with trypsin and the resulting peptide fragments were analyzed by mass spectrometry. Secreted Vif could be clearly identified (coverage: 72.20%) (data not shown).

Purification and Factor Xa Cleavage of His-Tagged IFN2α

Figure 19:
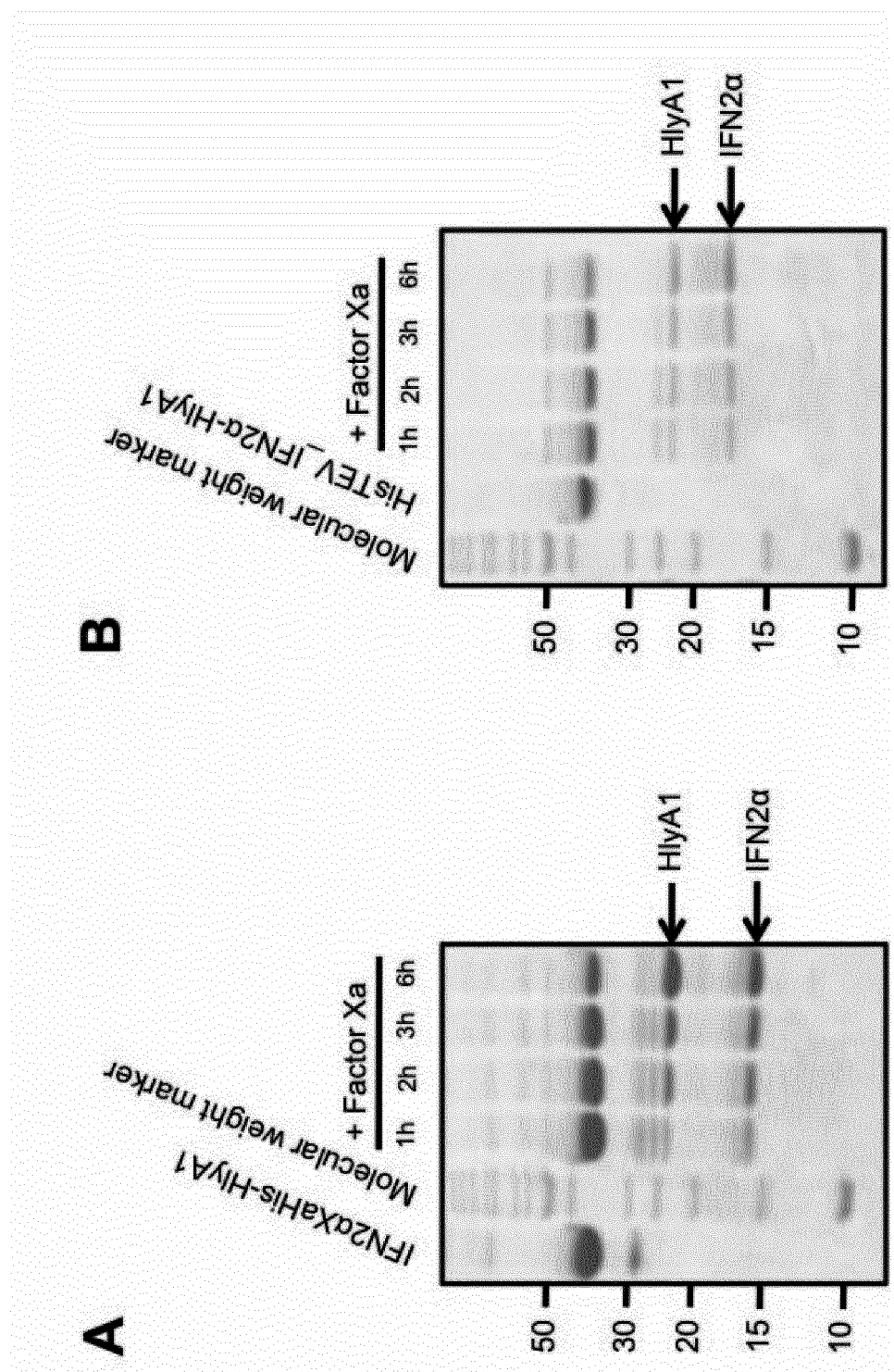
FIG. 19 shows the proteolytic cleavage of the secretion signal from secreted IFN2α. A: Secreted IFN2αXaHis-HlyA1 was purified by IMAC from the culture supernatant. 50 µg IFN2αXaHis-HlyA1 were incubated with 1 µL Factor Xa (NEB) and samples were taken at the indicated time points and analyzed by SDS-PAGE with subsequent CBB staining. B: HisTEV_IFN2α-HlyA1 was treated as described in A.

All growth media contained kanamycin (30 µg/mL) and ampicillin (100 µg/mL). For secretion experiments 2×YT medium supplemented with 5 mM $CaCl_2$ was used. 50 mL cultures of cells carrying pK184-HlyBD and pSU-HisTEV_IFN2α or pSU-IFN2αXaHis were grown with a start $OD_{600}$ of 0.1 at 37° C. and 160 rpm. The expression was induced with 1 mM IPTG at an $OD_{600}$ of 0.4-0.6 for 6 h. Cultures were centrifuged (20 min, 50.000×g, 4° C.) and supernatant samples (16 µL) and cells (ODeq=0.08) were analyzed by SDS-PAGE and Coomassie Brilliant Blue (CBB) staining Cells were separated from secreted IFN2α by centrifugation for 20 min and 14,000×g at 4° C. The supernatant was supplemented with 10 mM imidazole and 20 mM $MgCl_2$. For the subsequent immobilized metal ion affinity chromatography (IMAC) the supernatant was loaded on a HiTrap IMAC HP column (5 mL, GE Healthcare) preloaded with $Ni^{2+}$ and preequilibrated in buffer (10 mM Tris-HCl, 150 mM NaCl, 10 mM imidazole, pH 8.0) using a FPLC system (ÄktaSystem, GE Healthcare). After washing of the column with the same buffer, secreted IFN2α was eluted via a linear gradient of 10 column volumes from 10-250 mM imidazole. Protein containing fractions were pooled and concentrated by ultrafiltration (Amicon Filter devices, 10 kDa MWCO). 50 µg secreted IFN2α was cleaved with 1 µg Factor Xa (NEB) at 25° C. Samples were taken at indicated time points and analyzed by SDS-PAGE and subsequent CBB staining (FIG. 19). The secreted IFN2α was extracted and purified from the culture supernatant by IMAC and the secretion signal was cleaved off proteolytically with Factor Xa.

Nisin

All growth media contained kanamycin (30 µg/mL) and ampicillin (100 µg/mL). For secretion experiments 2×YT medium supplemented with 5 mM $CaCl_2$ was used. 50 mL cultures of cells carrying pK184-HlyBD and pSU-NisinXa were grown with a start $OD_{600}$ of 0.1 at 37° C. and 160 rpm. The expression was induced with 1 mM IPTG at an $OD_{600}$ of 0.4-0.6 for 6 h. Cultures were centrifuged (20 min, 50.000×g, 4° C.) and supernatant samples (16 µL) and cells (ODeq=0.08) were analyzed by SDS-PAGE and Coomassie Brilliant Blue (CBB) staining. 100 mL supernatant was concentrated to ~2 mL by ultrafiltration (Amicon filter device, 50 kDa MWCO). The concentrate was purified by size-exclusion chromatography (Superdex 200 16/60, GE Healthcare) equilibrated in SEC buffer (10 mM Tris-HCl, 120 mM NaCl, 5 mM Ca$_2$Cl, pH 7.3) using a FPLC system (GE Healthcare). Desired elution fractions were concentrated by ultrafiltration. Analytical RP-HPLC was performed with a LiChrospher WP 300 RP-18 end capped column (Merck) at room temperature. Samples were injected and eluted by mixing the aqueous buffer A (10% acetonitrile, 0.1% (v/v) trifluoroacetic acid) with the organic solvent buffer B (90% acetonitrile, 0.1% (v/v) trifluoroacetic acid). Elution was performed by applying a gradient of 0-100% of buffer B over the course of 60 min. at a flow rate of 1 ml/min. The eluent was detected by measuring the absorbance at 220 nm. Secreted NisA was purified by SEC (Superdex 75 16/60, GE Healthcare) and concentrated by ultrafiltration (Amicon Filter Devices, 10 kDa MWCO). 1 µg Factor Xa was added to 50 µg NisA-HlyA1 and incubated at 25° C. for the indicated period. After 1.5 h, the reaction was loaded onto a HPLC column and NisA eluted at 19 min. NisA could be identified by western blotting with an antibody against NisA and by mass spectrometry. (data not shown).

Human Calcitonin

All growth media contained kanamycin (30 µg/mL) and ampicillin (100 µg/mL). For secretion experiments 2×YT medium supplemented with 5 mM CaCl$_2$ was used. 50 mL cultures of cells carrying pK184-HlyBD and pSU-Human Calcitonin were grown with a start OD$_{600}$ of 0.1 at 37° C. and 160 rpm. The expression was induced with 1 mM IPTG at an OD$_{600}$ of 0.4-0.6 for 6 h. Cultures were centrifuged (20 min, 50.000×g, 4° C.) and supernatant samples (16 µL) and cells (ODeq=0.08) were analyzed by SDS-PAGE and Coomassie Brilliant Blue (CBB) staining 100 mL supernatant was concentrated to ~2 mL by ultrafiltration (Amicon filter device, 50 kDa MWCO). The concentrate was purified by size-exclusion chromatography (Superdex 200 16/60, GE Healthcare) equilibrated in SEC buffer (10 mM Tris-HCl, 120 mM NaCl, 5 mM Ca$_2$Cl, pH 7.3) using a FPLC system (GE Healthcare). Desired elution fractions were concentrated by ultrafiltration and incubated with TEV protease (10 mM DTT was also added). The digestion mixture was purified by size-exclusion chromatography (Peptide column, GE Healthcare) in 10 mM Tris-HCl, 120 mM NaCl, 5 mM CaCl$_2$, 10 mM DTT, pH 7.3. (data not shown).

| Peptide/protein of interest | Construct | Forward primer | Reverse primer | Vector insert sequence/ encoding sequence SEQ ID NO: | Protein sequence/ SEQ ID NO: |
|---|---|---|---|---|---|
| IFNα2 | pSU-HisTEV_IFN2α | 218 | 219 | 220/221 | 222 |
| IFNα2 | pSU-IFN2αXaHis | 225 | 226 | 227/228 | 229 |
| CalB | pSU-calB + Xa site | 232 | 233 | 234/235 | 236 |
| Nisin | pSU-Nisin + Xa site | 237 | 238 | 239/240 | 241 |
| SprP | pSU-SprPminLS | 242 | 243 | 244/245 | 246 |
| SprP | pSU-HisTEV SprP | 247 | 248 | 249/250 | 251 |
| SprP | pSU-SprPXaHis | 252 | 253 | 254/255 | 256 |
| SprP | pSU-SprP_ORF2 | 257 | 258 | 259/260 | 261 |
| SprP | pSU-SprP_Sub | 262 | 263 | 264/265 | 266 |
| PlaB (unnamed *Pseudomonas aeruginosa* PAO1 protein) | pSU-PlaB | 267 | 268 | 269/270 | 271 |
| PlaK (unnamed *Pseudomonas aeruginosa* PAO1 protein) | pSU-PlaK | 272 | 273 | 274/275 | 276 |
| PlbF (unnamed *Pseudomonas aeruginosa* PAO1 protein) | pSU-PlbF | 277 | 278 | 279/280 | 281 |
| tesA gene product (*Pseudomonas aeruginosa* PAO1 protein) | pSU-TesA | 282 | 283 | 284/285 | 286 |
| MBP | pSU-MBP | 287 | 288 | 289/290 | 291 |
| Vif | pSU-Vif | 292 | 293 | 294/295 | 296 |
| LipA | pSU-LipA | 297 | 298 | 299/300 | 301 |
| 2xHCRF | pSU-2xHCRF | 302 | 303 | 304/305 | 306 |

The IFNα2 construct pSU-HisTEV_IFN2α was cloned using the following strategy: The synthetic gene was amplified with the indicated oligonucleotides (SEQ ID NO:218 and 219). The pSU vector was amplified and linearized by PCR with the oligonucleotides of SEQ ID NO:223 and 224. Gel extracted PCR products were used for the In-Fusion reaction. For the construct pSU-IFN2αXaHis a similar strategy was used only that different oligonucleotide primers were used (see Table; and for vector amplification and linearization: SEQ ID Nos. 230 and 231). All other constructs were similarly cloned using the sequences indicated in the Table.

For the linearization and amplification of pSU-HCRF the following oligonucleotides were used pSU HlyA1_lin_rev:
(SEQ ID NO: 307)
CATTTAATTACCTCTTAACCAGTTAATG pSU_Cortico_lin_for:
(SEQ ID NO: 308)
AGCGAAGAACCGCCG For the linearization and amplification of pSU-HisTEV SprP the following oligonucleotides were used:

pSU HlyA1_lin_for:
(SEQ ID NO: 309)
GGAAATTCTCTTGCAAAAAATGTATTA pSU_A1_lin_HisTEV_rev:
(SEQ ID NO: 310)
GCCCTGAAAATACAGGTTTTCGTGGTGGTGGTGGTGCATTTAATTAC
CTCTTAACCAGTTAATG Example 12

N-Terminal Elongation of IFN2α Fusion Proteins by the RTX Domain of pSU-HlyA1

Cloning procedures are done with the Infusion Cloning Kit (ClonTech) as described above for other examples yielding plasmid pSU-GG_IFN2α. The encoding nucleotide sequence is set forth in SEQ ID NO:315 and the protein sequence in SEQ ID NO:316.

Oligonucleotides:

IFN2α_lin_for:
(SEQ ID NO: 311)
TGTGATCTGCCGCAGAC

IFN2α_lin_rev:
(SEQ ID NO: 312)
CATTTAATTACCTCTTAACCAGTTAATGAAAA

GGfor2α_for:
(SEQ ID NO: 313)
AGAGGTAATTAAATGGGAAATTCTCTTG

GGfor2α_rev:
(SEQ ID NO: 314)
CTGCGGCAGATCACAATCAATATCAGCCAAACTGAGTTTATC

All growth media contained kanamycin (30 μg/mL) and ampicillin (100 μg/mL). For secretion experiments 2×YT medium supplemented with 5 mM $CaCl_2$ was used. 50 mL cultures of cells carrying pK184-HlyBD and pSU-GG_IFN2α were grown with a start $OD_{600}$ of 0.1 at 37° C. and 160 rpm. The expression was induced with 1 mM IPTG at an $OD_{600}$ of 0.4-0.6 for 6 h. Cultures were centrifuged (20 min, 50.000×g, 4° C.) and supernatant samples (16 μL) and cells (ODeq=0.08) were analyzed by SDS-PAGE and Coomassie Brilliant Blue (CBB) staining.

Figure 20:
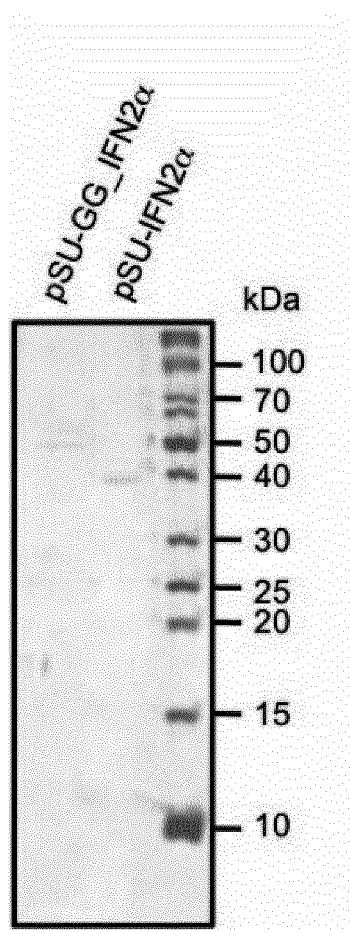
FIG. 20 shows a secretion analysis of pSU-GG_IFN2α in comparison to pSU-IFN2α.

As shown in FIG. 20, GG_IFN2α is secreted in similar amounts as IFN2α. These results demonstrate that a protein or peptide of interest might also be inserted inside HlyA1, if desired.

Example 13

Secretion Analysis with Various Interferons

Figure 21:
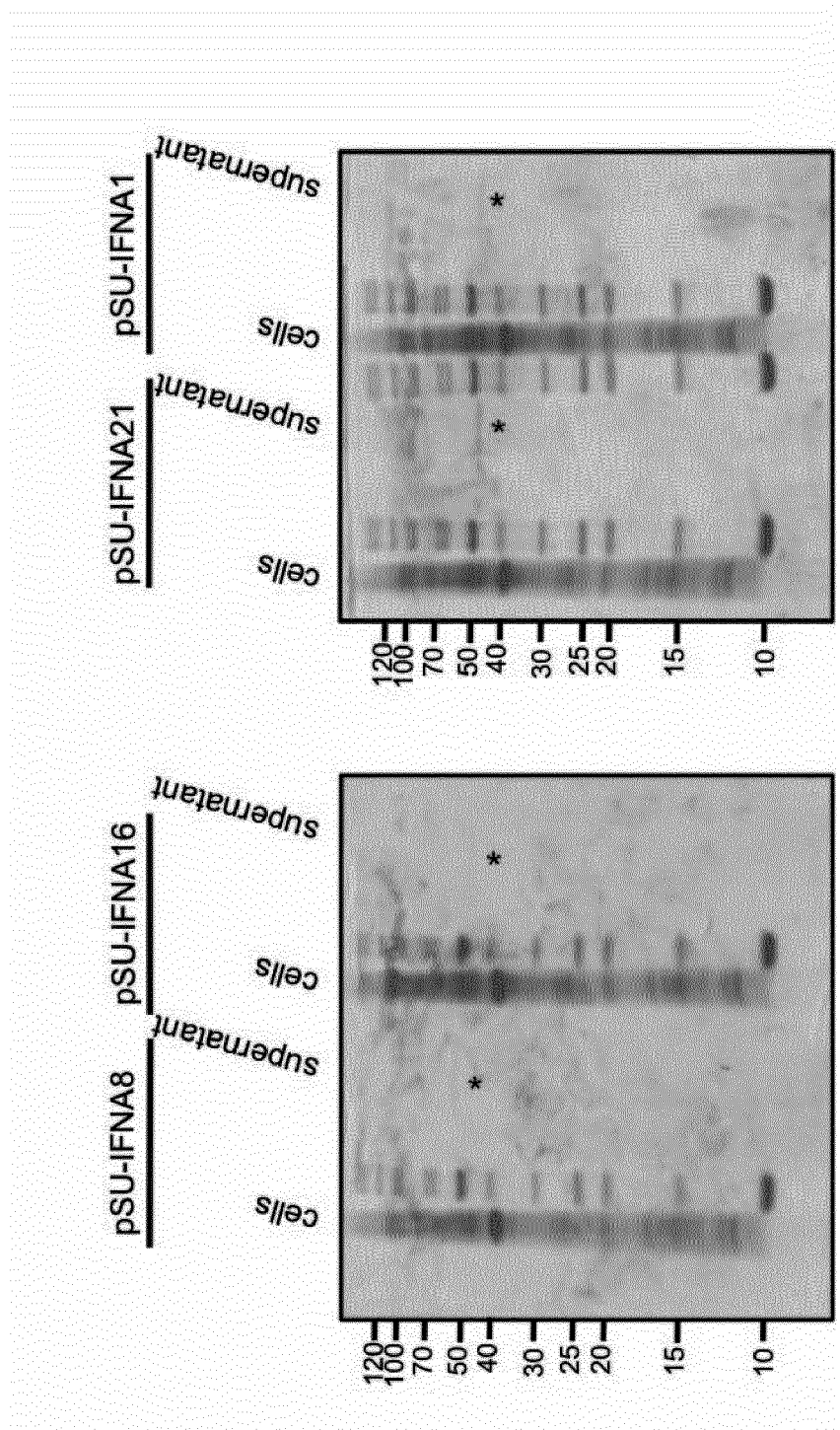
FIG. 21 shows a secretion analysis of the plasmids pSU-IFNA1, 8, 16 and 21, as indicated. Shown are CBB-stained SDS-PAGE gels of cell lysate (left) and supernatant (right) samples after the secretion experiments. Molecular weight standards are also shown.
Figure 22:
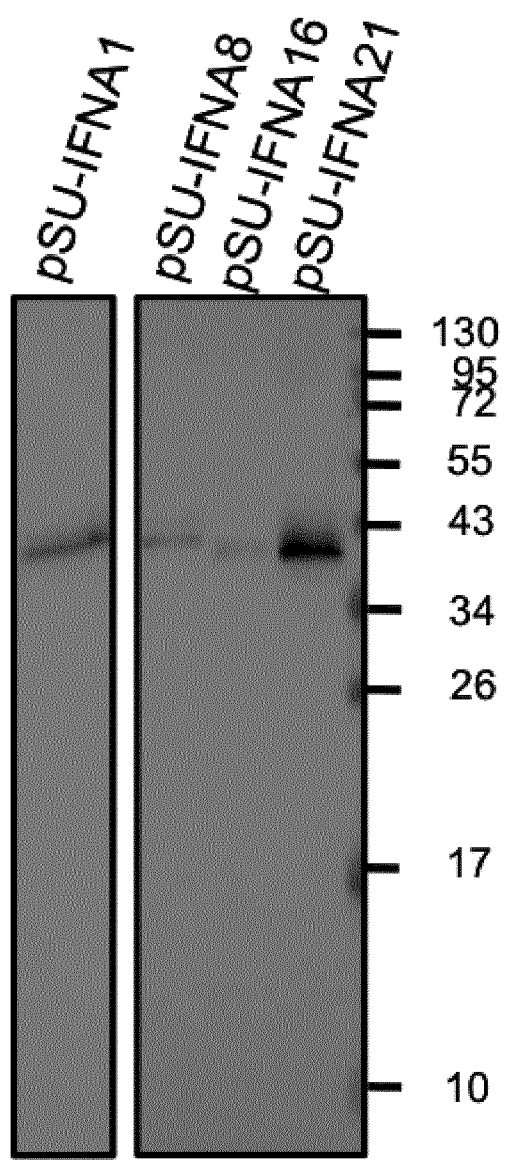
FIG. 22 shows Western blot analysis of supernatant samples after secretion analysis with pSJ37 in combination of the plasmids pSU-IFNA1, pSU-IFNA8, pSU-IFNA16 and pSU-IFNA21.

The fusion proteins IFNA1-HlyA1, IFNA8-HlyA1, IFNA16-HlyA1 and IFNA21-HlyA1 are produced and secreted with the invented secretion system (FIG. 21). The identity of secreted fusion proteins was confirmed by western blot analysis with an antibody against HlyA1 (FIG. 22).

| Peptide/ protein of interest | wildtype protein Accession No., Version No., date | Construct | Forward primer SEQ ID NO: | Reverse primer SEQ ID NO: | Vector insert sequence/ encoding sequence SEQ ID NO: | Protein sequence/ SEQ ID NO: |
|---|---|---|---|---|---|---|
| Human IFNalpha1 | NM_024013 Version: NM_024013.2 Gi:345441760 | pSU-IFNA1 | 317 | 318 | 325/326 | 333 |
| Human IFNalpha8 | NM_002170 Version: NM_002170.3 Gi:115583655 | pSU-IFNA8 | 319 | 320 | 327/328 | 334 |
| Human IFNalpha16 | NM_002173 Version: NM_002173.2 Gi:141802732 | pSU-IFNA16 | 321 | 322 | 329/330 | 335 |
| Human IFNalpha21 | NM_002175 Version: NM_002175.2 Gi:169791012 | pSU-IFNA21 | 323 | 324 | 331/332 | 336 |

The cloning was carried out as described above.

All documents cited herein, are hereby incorporated by reference in their entirety.

The inventions illustratively described herein may suitably be practiced in the absence of any element or elements, limitation or limitations, not specifically disclosed herein. Thus, for example, the terms "comprising", "including", "containing", etc. shall be read expansively and without limitation. Additionally, the terms and expressions employed herein have been used as terms of description and not of limitation, and there is no intention in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments and optional features, modification and variation of the inventions embodied therein herein disclosed may be resorted to by those skilled in the art, and that such modifications and variations are considered to be within the scope of this invention. The invention has been described broadly and generically herein. Each of the narrower species and subgeneric groupings falling within the generic disclosure also form part of the invention. This includes the generic description of the invention with a proviso or negative limitation removing any subject matter from the genus, regardless of whether or not the excised material is specifically recited herein. In addition, where features or aspects of the invention are described in terms of Markush groups, those skilled in the art will recognize that the invention is also thereby described in terms of any individual member or subgroup of members of the Markush group. Further embodiments of the invention will become apparent from the following claims.

SEQUENCE LISTING (338 sequences)

SEQ ID NO: 1 - DNA, 522 bp, Artificial
  3' Fragment of HlyC + gap
gaatataaacaaaccattagagattcttgggcatgtatcctggctatgggccagttctccactacacagaaactggccagtatctttgtttgcaataaatgtattacccgcaatacaggctaaccaatatgttttattaacccgggatgattaccctgtcgcgtattgtagttgggctaatttaagtttagaaaatgaaattaaatatcttaatgatgttacctcattagttgcagaagactggacttcaggtgatcgtaaatggttcattgactggattgctcctttcggggataacggtgccctgtacaaatatatgcgaaaaaaattccctgatgaactattcagagccatcagggtggatcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaa

SEQ ID NO: 2 - DNA, 11 bp, Artificial
  Gap sequence between HlyC and HlyA genes
gaggtaattaa

SEQ ID NO: 3 - DNA, 14 bp, Artificial
  3' fragment of HlyC + gap
taagaggtaattaa

SEQ ID NO: 4 - DNA, 15 bp, Artificial
  3' fragment of HlyC + gap
ttaagaggtaattaa

SEQ ID NO: 5 - DNA, 17 bp, Artificial
  3' fragment of HlyC + gap
ggttaagaggtaattaa

SEQ ID NO: 6 - DNA, 23 bp, Artificial
  3' fragment of HlyC + gap
ttaactggttaagaggtaattaa

SEQ ID NO: 7 - DNA, 32 bp, Artificial
  3' fragment of HlyC + gap
aatttttcattaactggttaagaggtaattaa

SEQ ID NO: 8 - DNA, 41 bp, Artificial
  3' fragment of HlyC + gap
tcagattttaatttttcattaactggttaagaggtaattaa

SEQ ID NO: 9 - DNA, 62 bp, Artificial
  3' fragment of HlyC + gap
ataactgaagtaaaaagaaagtcagattttaatttttcattaactggttaagaggtaattaa

SEQ ID NO: 10 - DNA, 83 bp, Artificial
  3' fragment of HlyC + gap
aaacaatatcaccacgagttaataactgaagtaaaaagaaagtcagattttaatttttcattaactggttaagaggtaattaa

SEQ ID NO: 11 - DNA, 104 bp, Artificial
  3' fragment of HlyC + gap
cagttagcgaataaaatttttaaacaatatcaccacgagttaataactgaagtaaaaagaaagtcagattttaatttttcattaactggttaagaggtaattaa

SEQ ID NO: 12 - DNA, 159 bp, Artificial
  3' fragment of HlyC + gap
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaa

SEQ ID NO: 13 - DNA, 219 bp, Artificial
  3' fragment of HlyC + gap
cctgtacaaatatatgcgaaaaaaattccctgatgaactattcagagccatcagggtggatcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaa

SEQ ID NO: 14 - DNA, 279 bp, Artificial
  3' fragment of HlyC + gap
gacttcaggtgatcgtaaatggttcattgactggattgctcctttcggggataacggtgccctgtacaaatatatgcgaaaaaaattccctgatgaactattcagagccatcagggtggatcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaa

SEQ ID NO: 15 - DNA, 339 bp, Artificial
  3' fragment of HlyC + gap
aagtttagaaaatgaaattaaatatcttaatgatgttacctcattagttgcagaagactggacttcaggtgatcgtaaatggttcattgactggattgctcctttcggggataacggtgccctgtacaaatatatgcgaaaaaaattccctgatgaactattcagagccatcagggtggatcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaa

SEQ ID NO: 16 - DNA, 399 bp, Artificial
  3' fragment of HlyC + gap
ccaatatgttttattaacccgggatgattaccctgtcgcgtattgtagttgggctaatttaagtttagaaaatgaaattaaatatcttaatgatgttacctcattagttgcagaagactggacttcaggtgatcgtaaatggttcattgactggattgctcctttcggggataacggtgccctgtacaaatatatgcgaaaaaaattccctgatgaactattcagagccatcagggtggatcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaa

SEQ ID NO: 17 - DNA, 459 bp, Artificial
  3' fragment of HlyC + gap
acacagaaactggccagtatctttgtttgcaataaatgtattacccgcaatacaggctaaccaatatgttttattaacccgggatgattaccctgtcgcgtattgtagttgggctaatttaagtttagaaaatgaaattaaatatcttaatgatgttacctcattagttgcagaagactggacttcaggtgatcgtaaatggttcattgactggattgctcctttcggggataacggtgccctgtacaaatatatgcgaaaaaaattccctgatgaactattcagagccatcagggtggatcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaa

SEQ ID NO: 18 - DNA, 521 bp, Artificial
  3' fragment of HlyC + gap
aatataaacaaaccattagagattcttgggcatgtatcctggctatgggccagttctccactacacagaaactggccagtatctttgtttgcaataaatgtattacccgcaatacaggctaaccaatatgttttattaacccgggatgattaccctgtcgcgtattgtagttgggctaatttaagtttagaaaatgaaattaaatatcttaatgatgttacctcattagttgcagaagactggacttcaggtgatcgtaaatggttcattgactggattgctcctttcggggataacggtgccctgtacaaatatatgcgaaaaaaattccctgatgaactattcagagccatcagggtggatcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaa

SEQ ID NO: 19 - DNA, 474 bp, Artificial
  3' fragment of HlyC + gap
ggccagttctccactacacagaaactggccagtatctttgtttgcaataaatgtattacccgcaatacaggctaaccaatatgttttattaacccgggatgattaccctgtcgcgtattgtagttgggctaatttaagtttagaaaatgaaattaaatatcttaatgatgttacctcattagttgcagaagactggacttcaggtgatcgtaaatggttcattgactggattgctcctttcggggataacggtgccctgtacaaatatatgcgaaaaaaattccctgatgaactattcagagccatcagggtggatcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaa

SEQ ID NO: 20 - DNA, 424 bp, Artificial
  3' fragment of HlyC + gap
atgtattacccgcaatacaggctaaccaatatgttttattaacccgggatgattaccctgtcgcgtattgtagttgggctaatttaagtttagaaaatgaaattaaatatcttaatgatgttacctcattagttgcagaagactggacttcaggtgatcgtaaatggttcattgactggattgctcctttcggggataacggtgccctgtacaaatatatgcgaaaaaaattccctgatgaactattcagagccatcagggtggatcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaa

SEQ ID NO: 21 - DNA, 324 bp, Artificial
  3' fragment of HlyC + gap
aattaaatatcttaatgatgttacctcattagttgcagaagactggacttcaggtgatcgtaaatggttcattgactggattgctcctttcggggataacggtgccctgtacaaatatatgcgaaaaaaattccctgatgaactattcagagccatcagggtggatcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaa

SEQ ID NO: 22 - DNA, 124 bp, Artificial
  3' fragment of HlyC + gap
atggaggtaaaattgataaacagttagcgaataaaatttttaaacaatatcaccacgagttaataactgaagtaaaaagaaagtcagattttaatttttcattaactggttaagaggtaattaa

SEQ ID NO: 23 - DNA, 111 bp, Artificial
  3' fragment of HlyC + gap
tgataaacagttagcgaataaaatttttaaacaatatcaccacgagttaataactgaagtaaaaagaaagtcagattttaatttttcattaactggttaagaggtaattaa

SEQ ID NO: 24 - DNA, 86 bp, Artificial
  3' fragment of HlyC + gap
tttaaacaatatcaccacgagttaataactgaagtaaaaagaaagtcagattttaatttttcattaactggttaagaggtaattaa

SEQ ID NO: 25 - DNA, 61 bp, Artificial
  3' fragment of HlyC + gap
taactgaagtaaaaagaaagtcagattttaatttttcattaactggttaagaggtaattaa

SEQ ID NO: 26 - DNA, 36 bp, Artificial
  3' fragment of HlyC + gap
ttttaatttttcattaactggttaagaggtaattaa

SEQ ID NO: 27 - DNA, 21 bp, Artificial
  3' fragment of HlyC + gap
aactggttaagaggtaattaa

SEQ ID NO: 28 - DNA, 10 bp, Artificial
  3' fragment of gap sequence between HlyC and HlyA genes
aggtaattaa

SEQ ID NO: 29 - DNA, 3072 bp, Artificial Sequence
  Artificial Sequence
atgacaacaataaccactgcacaaattaaaagcacactgcagtctgcaaagcaatccgctgcaaataaattgcactcagcaggacaaagcacgaaagatgcattaaaaaaagcagcagagcaaacccgcaatgcgggaaacagactcattttacttatccctaaagattataaaggacagggttcaagccttaatgaccttgtcaggacggcagatgaactgggaattgaagtccagtatgatgaaaagaatggcacggcgattactaaacaggtgttcggcacagcagagaaactcattggcctcaccgaacggggagtgactatctttgcaccacaattagacaaattactgcaaaagtatcaaaaagcaggtaatatattaggtggcggtgctgaaaatatcggtgataacttaggaaaggcaggcggtatattgtcaacgtttcaaaatttcctgggtactgcactttcctcaatgaaaatagacgaactgataaagaaacaaaaatctggtggcaatgtcagttcttctgagatggcagaagcgagtattgagctaatcaatcaacttgtggatacagttgccagccttaataataatgttaactcattttctcaacaactcaatactctgggaagtgtattatccaatacaaagcacctgaacggtgttggtaataagttacagaatttacctaatcttgataatatcggtgcagggttagatactgtatcgggtattttatctgcgatttcagcaagcttcattctgagcaatgcagatgcagataccagaactaaagctgcagcaggtgttgaattaacaacgaaagtactgggtaatgttggaaaaggtatttctcaatatattatcgcacagcgcgctgcacaggggttatctacatctgctgctgctgccggtttaattgcttctgctgtgacactagcaattagtcccctctcattcctgtccattgccgataagtttaaacgtgccaataaaatagaggagtattcacaacgattcaaaaaacttggatacgatggtgacagtttacttgctgctttccacaaagaaacaggggctattgatgcatcattaacaacgataagcactgtactggcttcagtatcttcaggtattagtgctgctgcaacgacatctctggttggtgcaccggtaagcgcgctggtaggcgctgttacggggataatttcaggtatccttgaggcttcaaagcaggcaatgtttgaacatgttgccagtaaaatggctgatgttattgctgaatgggagaaaaaacacggcaaaaattactttgaaaatggatatgatgcccgccatgctgcatttttagaagataactttaaaatattatctcagtataataaagagtattctgttgaaagatcagtcctcattacccagcaacattgggatacgctgataggtgagttagctggtgtcaccagaaatggagacaaaacactcagtggtaaaagttatattgactattatgaagaaggaaaacgtctggagaaaaaaccggatgaattccagaagcaagtctttgacccattgaaaggaaatattgacctttctgacagcaaatcttctacgttattgaaatttgttacgccattattaactcccggtgaggaaattcgtgaaaggaggcagtccggaaaatatgaatatattaccgagttattagtcaagggtgttgataaatggacggtgaagggggttcaggacaagggggctgtatatgattactctaacctgattcagcatgcatcagtcggtaataaccagtatcgggaaatccgtattgagtcacacctgggagacggggatgataaggtctttttatctgccggctcagccaatatctacgcaggtaaaggacatgatgttgtttattatgataaaacagacactggttatctgaccattgatggcacaaaagcaaccgaagcgggtaattacacggtaacacgtgtacttggtggcgatgttaaggttttacaggaagttgtgaaggagcaggaggtttcagtcggaaaaagaactgaaaaaacgcaatatcggagttatgaattcactcatatcaatggtaaaaatttaacagagactgataacttatattccgtggaagaacttattgggaccacgcgtgccgacaagttttttggcagtaaatttactgatatcttccatggcgcggatggtgatgaccttatagaaggaaatgatgggaatgaccgcttatatggtgataaaggtaatgacacactgagtggtggaaacggagatgaccagctctatggcggtgatggtaacgataagttgattgggggagcaggtaataattacctgaacggcggagatggagatgatgagcttcaggttcagggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagca

SEQ ID NO: 30 - DNA, 126 bp, Artificial
  fragment of HlyA
ccattaattaatgaaatcagcaaaatcatttcagctgcaggtagcttcgatgttaaagaggaaagaactgcagcttctttattgcagttgtccggtaatgccagtgatttttcatatggacggaac

SEQ ID NO: 31 - DNA, 3069 bp, Artificial
  fragment of HlyA
acaacaataaccactgcacaaattaaaagcacactgcagtctgcaaagcaatccgctgcaaataaattgcactcagcaggacaaagcacgaaagatgcattaaaaaaagcagcagagcaaacccgcaatgcgggaaacagactcattttacttatccctaaagattataaaggacagggttcaagccttaatgaccttgtcaggacggcagatgaactgggaattgaagtccagtatgatgaaaagaatggcacggcgattactaaacaggtgttcggcacagcagagaaactcattggcctcaccgaacggggagtgactatctttgcaccacaattagacaaattactgcaaaagtatcaaaaagcaggtaatatattaggtggcggtgctgaaaatatcggtgataacttaggaaaggcaggcggtatattgtcaacgtttcaaaatttcctgggtactgcactttcctcaatgaaaatagacgaactgataaagaaacaaaaatctggtggcaatgtcagttcttctgagatggcagaagcgagtattgagctaatcaatcaacttgtggatacagttgccagccttaataataatgttaactcattttctcaacaactcaatactctgggaagtgtattatccaatacaaagcacctgaacggtgttggtaataagttacagaatttacctaatcttgataatatcggtgcagggttagatactgtatcgggtattttatctgcgatttcagcaagcttcattctgagcaatgcagatgcagataccagaactaaagctgcagcaggtgttgaattaacaacgaaagtactgggtaatgttggaaaaggtatttctcaatatattatcgcacagcgcgctgcacaggggttatctacatctgctgctgctgccggtttaattgcttctgctgtgacactagcaattagtcccctctcattcctgtccattgccgataagtttaaacgtgccaataaaatagaggagtattcacaacgattcaaaaaacttggatacgatggtgacagtttacttgctgctttccacaaagaaacaggggctattgatgcatcattaacaacgataagcactgtactggcttcagtatcttcaggtattagtgctgctgcaacgacatctctggttggtgcaccggtaagcgcgctggtaggcgctgttacggggataatttcaggtatccttgaggcttcaaagcaggcaatgtttgaacatgttgccagtaaaatggctgatgttattgctgaatgggagaaaaaacacggcaaaaattactttgaaaatggatatgatgcccgccatgctgcatttttagaagataactttaaaatattatctcagtataataaagagtattctgttgaaagatcagtcctcattacccagcaacattgggatacgctgataggtgagttagctggtgtcaccagaaatggagacaaaacactcagtggtaaaagttatattgactattatgaagaaggaaaacgtctggagaaaaaaccggatgaattccagaagcaagtctttgacccattgaaaggaaatattgacctttctgacagcaaatcttctacgttattgaaatttgttacgccattattaactcccggtgaggaaattcgtgaaaggaggcagtccggaaaatatgaatatattaccgagttattagtcaagggtgttgataaatggacggtgaagggggttcaggacaagggggctgtatatgattactctaacctgattcagcatgcatcagtcggtaataaccagtatcgggaaatccgtattgagtcacacctgggagacggggatgataaggtctttttatctgccggctcagccaatatctacgcaggtaaaggacatgatgttgtttattatgataaaacagacactggttatctgaccattgatggcacaaaagcaaccgaagcgggtaattacacggtaacacgtgtacttggtggcgatgttaaggttttacaggaagttgtgaaggagcaggaggtttcagtcggaaaaagaactgaaaaaacgcaatatcggagttatgaattcactcatatcaatggtaaaaatttaacagagactgataacttatattccgtggaagaacttattgggaccacgcgtgccgacaagttttttggcagtaaatttactgatatcttccatggcgcggatggtgatgaccttatagaaggaaatgatgggaatgaccgcttatatggtgataaaggtaatgacacactgagtggtggaaacggagatgaccagctctatggcggtgatggtaacgataagttgattgggggagcaggtaataattacctgaacggcggagatggagatgatgagcttcaggttcagggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagca

SEQ ID NO: 32 - DNA, 852 bp, Artificial
  fragment of HlyA
catggcgcggatggtgatgaccttatagaaggaaatgatgggaatgaccgcttatatggtgataaaggtaatgacacactgagtggtggaaacggagatgaccagctctatggcggtgatggtaacgataagttgattgggggagcaggtaataattacctgaacggcggagatggagatgatgagcttcaggttcagggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagca

SEQ ID NO: 33 - DNA, 708 bp, Artificial
  fragment of HlyA
gcaggtaataattacctgaacggcggagatggagatgatgagcttcaggttcagggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagca

SEQ ID NO: 34 - DNA, 654 bp, Artificial
  fragment of HlyA
ggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagca

SEQ ID NO: 35 - DNA, 600 bp, Artificial
  fragment of HlyA
tacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagca

SEQ ID NO: 36 - DNA, 549 bp, Artificial
  fragment of HlyA
ctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagca

SEQ ID NO: 37 - DNA, 489 bp, Artificial
  fragment of HlyA
attgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagca

SEQ ID NO: 38 - DNA, 450 bp, Artificial
  fragment of HlyA
gctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagca

SEQ ID NO: 39 - DNA, 180 bp, Artificial
  fragment of HlyA
ttagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagca

SEQ ID NO: 40 - DNA, 150 bp, Artificial
  fragment of HlyA
ccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagca

SEQ ID NO: 41 - protein, 1024 aa, Artificial
  Artificial Sequence
MTTITTAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNILGGGAENIGDNLGKAGGILSTFQNFLGTALSSMKIDELIKKQKSGGNVSSSEMAEASIELINQLVDTVASLNNNVNSFSQQLNTLGSVLSNTKHLNGVGNKLQNLPNLDNIGAGLDTVSGILSAISASFILSNADADTRTKAAAGVELTTKVLGNVGKGISQYIIAQRAAQGLSTSAAAAGLIASAVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKPDEFQKQVFDPLKGNIDLSDSKSSTLLKFVTPLLTPGEEIRERRQSGKYEYITELLVKGVDKWTVKGVQDKGAVYDYSNLIQHASVGNNQYREIRIESHLGDGDDKVFLSAGSANIYAGKGHDVVYYDKTDTGYLTIDGTKATEAGNYTVTRVLGGDVKVLQEVVKEQEVSVGKRTEKTQYRSYEFTHINGKNLTETDNLYSVEELIGTTRADKFFGSKFTDIFHGADGDDLIEGNDGNDRLYGDKGNDTLSGGNGDDQLYGGDGNDKLIGGAGNNYLNGGDGDDELQVQGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 42 - protein, 42 aa, Artificial
  fragment of HlyA
PLINEISKIISAAGSFDVKEERTAASLLQLSGNASDFSYGRN

SEQ ID NO: 43 - protein, 1023 aa, Artificial
  fragment of HlyA
TTITTAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNILGGGAENIGDNLGKAGGILSTFQNFLGTALSSMKIDELIKKQKSGGNVSSSEMAEASIELINQLVDTVASLNNNVNSFSQQLNTLGSVLSNTKHLNGVGNKLQNLPNLDNIGAGLDTVSGILSAISASFILSNADADTRTKAAAGVELTTKVLGNVGKGISQYIIAQRAAQGLSTSAAAAGLIASAVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKPDEFQKQVFDPLKGNIDLSDSKSSTLLKFVTPLLTPGEEIRERRQSGKYEYITELLVKGVDKWTVKGVQDKGAVYDYSNLIQHASVGNNQYREIRIESHLGDGDDKVFLSAGSANIYAGKGHDVVYYDKTDTGYLTIDGTKATEAGNYTVTRVLGGDVKVLQEVVKEQEVSVGKRTEKTQYRSYEFTHINGKNLTETDNLYSVEELIGTTRADKFFGSKFTDIFHGADGDDLIEGNDGNDRLYGDKGNDTLSGGNGDDQLYGGDGNDKLIGGAGNNYLNGGDGDDELQVQGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 44 - protein, 284 aa, Artificial
  fragment of HlyA
HGADGDDLIEGNDGNDRLYGDKGNDTLSGGNGDDQLYGGDGNDKLIGGAGNNYLNGGDGDDELQVQGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 45 - protein, 236 aa, Artificial
  fragment of HlyA
AGNNYLNGGDGDDELQVQGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 46 - protein, 218 aa, Artificial
  fragment of HlyA
GNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 47 - protein, 200 aa, Artificial
  fragment of HlyA
YGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 48 - protein, 183 aa, Artificial
  fragment of HlyA
LKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 49 - protein, 164 aa, Artificial
  fragment of HlyA
MIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 50 - protein, 150 aa, Artificial
  fragment of HlyA
ADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 51 - protein, 60 aa, Artificial
  fragment of HlyA
LAYGSQGDLNPLINEISKIISAAGSFDVKEERTAASLLQLSGNASDFSYGRNSITLTTSA

SEQ ID NO: 52 - protein, 50 aa, Artificial
  fragment of HlyA
PLINEISKIISAAGSFDVKEERTAASLLQLSGNASDFSYGRNSITLTTSA

SEQ ID NO: 53 - DNA, 31 bp, Artificial Sequence
  Artificial Sequence
tatattaatttaaatgatagcaatcttactg

SEQ ID NO: 54 - DNA, 25 bp, Artificial Sequence
  Artificial Sequence
ttaattacctcttaaccagttaatg

SEQ ID NO: 55 - DNA, 40 bp, Artificial Sequence
  Artificial Sequence
ttaagaggtaattaaatgggaaattctcttgcaaaaaatg

SEQ ID NO: 56 - DNA, 33 bp, Artificial Sequence
  Artificial Sequence
atttaaattaatatattatgctgatgtggtcag

SEQ ID NO: 57 - DNA, 27 bp, Artificial Sequence
  Artificial Sequence
ggaaattctcttgcaaaaaatgtatta

SEQ ID NO: 58 - DNA, 28 bp, Artificial Sequence
  Artificial Sequence
catttaattacctcttaaccagttaatg

SEQ ID NO: 59 - DNA, 34 bp, Artificial Sequence
  Artificial Sequence
agaggtaattaaatgtgtgatctgccgcagactc

SEQ ID NO: 60 - DNA, 46 bp, Artificial Sequence
  Artificial Sequence
tgcaagagaatttccttccttacttcttaaactttcttgcaagttt

SEQ ID NO: 61 - DNA, 58 bp, Artificial Sequence
  Artificial Sequence
tgcaagagaatttccacggccatcaatttccttacttcttaaactttcttgcaagttt

SEQ ID NO: 62 - DNA, 6960 bp, Artificial
  pSU vector including HlyA full length
tgattacgaattcgagctcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgacaacaataaccactgcacaaattaaaagcacactgcagtctgcaaagcaatccgctgcaaataaattgcactcagcaggacaaagcacgaaagatgcattaaaaaaagcagcagagcaaacccgcaatgcgggaaacagactcattttacttatccctaaagattataaaggacagggttcaagccttaatgaccttgtcaggacggcagatgaactgggaattgaagtccagtatgatgaaaagaatggcacggcgattactaaacaggtgttcggcacagcagagaaactcattggcctcaccgaacggggagtgactatctttgcaccacaattagacaaattactgcaaaagtatcaaaaagcaggtaatatattaggtggcggtgctgaaaatatcggtgataacttaggaaaggcaggcggtatattgtcaacgtttcaaaatttcctgggtactgcactttcctcaatgaaaatagacgaactgataaagaaacaaaaatctggtggcaatgtcagttcttctgagatggcagaagcgagtattgagctaatcaatcaacttgtggatacagttgccagccttaataataatgttaactcattttctcaacaactcaatactctgggaagtgtattatccaatacaaagcacctgaacggtgttggtaataagttacagaatttacctaatcttgataatatcggtgcagggttagatactgtatcgggtattttatctgcgatttcagcaagcttcattctgagcaatgcagatgcagataccagaactaaagctgcagcaggtgttgaattaacaacgaaagtactgggtaatgttggaaaaggtatttctcaatatattatcgcacagcgcgctgcacaggggttatctacatctgctgctgctgccggtttaattgcttctgctgtgacactagcaattagtcccctctcattcctgtccattgccgataagtttaaacgtgccaataaaatagaggagtattcacaacgattcaaaaaacttggatacgatggtgacagtttacttgctgctttccacaaagaaacaggggctattgatgcatcattaacaacgataagcactgtactggcttcagtatcttcaggtattagtgctgctgcaacgacatctctggttggtgcaccggtaagcgcgctggtaggcgctgttacggggataatttcaggtatccttgaggcttcaaagcaggcaatgtttgaacatgttgccagtaaaatggctgatgttattgctgaatgggagaaaaaacacggcaaaaattactttgaaaatggatatgatgcccgccatgctgcatttttagaagataactttaaaatattatctcagtataataaagagtattctgttgaaagatcagtcctcattacccagcaacattgggatacgctgataggtgagttagctggtgtcaccagaaatggagacaaaacactcagtggtaaaagttatattgactattatgaagaaggaaaacgtctggagaaaaaaccggatgaattccagaagcaagtctttgacccattgaaaggaaatattgacctttctgacagcaaatcttctacgttattgaaatttgttacgccattattaactcccggtgaggaaattcgtgaaaggaggcagtccggaaaatatgaatatattaccgagttattagtcaagggtgttgataaatggacggtgaagggggttcaggacaagggggctgtatatgattactctaacctgattcagcatgcatcagtcggtaataaccagtatcgggaaatccgtattgagtcacacctgggagacggggatgataaggtctttttatctgccggctcagccaatatctacgcaggtaaaggacatgatgttgtttattatgataaaacagacactggttatctgaccattgatggcacaaaagcaaccgaagcgggtaattacacggtaacacgtgtacttggtggcgatgttaaggttttacaggaagttgtgaaggagcaggaggtttcagtcggaaaaagaactgaaaaaacgcaatatcggagttatgaattcactcatatcaatggtaaaaatttaacagagactgataacttatattccgtggaagaacttattgggaccacgcgtgccgacaagttttttggcagtaaatttactgatatcttccatggcgcggatggtgatgaccttatagaaggaaatgatgggaatgaccgcttatatggtgataaaggtaatgacacactgagtggtggaaacggagatgaccagctctatggcggtgatggtaacgataagttgattgggggagcaggtaataattacctgaacggcggagatggagatgatgagcttcaggttcagggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 63 - DNA, 4545 bp, Artificial
  pSU vector including HlyC fragment + gap + HlyA1
tgattacgaattcgagctcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 64 - DNA, 30 bp, Artificial Sequence
  Artificial Sequence
agaggtaattaaatgctaccttccggttcg

SEQ ID NO: 65 - DNA, 28 bp, Artificial Sequence
  Artificial Sequence
tgcaagagaatttccgggggtgacgatg

SEQ ID NO: 66 - DNA, 1770 bp, Artificial Sequence
  Artificial Sequence
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgctaccttccggttcggaccctgccttttcgcagcccaagtcggtgctcgatgcgggtctgacctgccagggtgcttcgccatcctcggtctccaaacccatccttctcgtccccggaaccggcaccacaggtccacagtcgttcgactcgaactggatccccctctctgcgcagctgggttacacaccctgctggatctcacccccgccgttcatgctcaacgacacccaggtcaacacggagtacatggtcaacgccatcaccacgctctacgctggttcgggcaacaacaagcttcccgtgctcacctggtcccagggtggtctggttgcacagtggggtctgaccttcttccccagtatcaggtccaaggtcgatcgacttatggcctttgcgcccgactacaagggcaccgtcctcgccggccctctcgatgcactcgcggttagtgcaccctccgtatggcagcaaaccaccggttcggcactcactaccgcactccgaaacgcaggtggtctgacccagatcgtgcccaccaccaacctctactcggcgaccgacgagatcgttcagcctcaggtgtccaactcgccactcgactcatcctacctcttcaacggaaagaacgtccaggcacaggctgtgtgtgggccgctgttcgtcatcgaccatgcaggctcgctcacctcgcagttctcctacgtcgtcggtcgatccgccctgcgctccaccacgggccaggctcgtagtgcagactatggcattacggactgcaaccctcttcccgccaatgatctgactcccgagcaaaaggtcgccgcggctgcgctcctggcgccggcggctgcagccatcgtggcgggtccaaagcagaactgcgagcccgacctcatgccctacgcccgcccctttgcagtaggcaaaaggacctgctccggcatcgtcacccccggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 67 - DNA, 1611 bp, Artificial Sequence
  Artificial Sequence
atgctaccttccggttcggaccctgccttttcgcagcccaagtcggtgctcgatgcgggtctgacctgccagggtgcttcgccatcctcggtctccaaacccatccttctcgtccccggaaccggcaccacaggtccacagtcgttcgactcgaactggatccccctctctgcgcagctgggttacacaccctgctggatctcacccccgccgttcatgctcaacgacacccaggtcaacacggagtacatggtcaacgccatcaccacgctctacgctggttcgggcaacaacaagcttcccgtgctcacctggtcccagggtggtctggttgcacagtggggtctgaccttcttccccagtatcaggtccaaggtcgatcgacttatggcctttgcgcccgactacaagggcaccgtcctcgccggccctctcgatgcactcgcggttagtgcaccctccgtatggcagcaaaccaccggttcggcactcactaccgcactccgaaacgcaggtggtctgacccagatcgtgcccaccaccaacctctactcggcgaccgacgagatcgttcagcctcaggtgtccaactcgccactcgactcatcctacctcttcaacggaaagaacgtccaggcacaggctgtgtgtgggccgctgttcgtcatcgaccatgcaggctcgctcacctcgcagttctcctacgtcgtcggtcgatccgccctgcgctccaccacgggccaggctcgtagtgcagactatggcattacggactgcaaccctcttcccgccaatgatctgactcccgagcaaaaggtcgccgcggctgcgctcctggcgccggcggctgcagccatcgtggcgggtccaaagcagaactgcgagcccgacctcatgccctacgcccgcccctttgcagtaggcaaaaggacctgctccggcatcgtcacccccggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 68 - protein, 536 aa, Artificial Sequence
  Artificial Sequence
MLPSGSDPAFSQPKSVLDAGLTCQGASPSSVSKPILLVPGTGTTGPQSFDSNWIPLSAQLGYTPCWISPPPFMLNDTQVNTEYMVNAITTLYAGSGNNKLPVLTWSQGGLVAQWGLTFFPSIRSKVDRLMAFAPDYKGTVLAGPLDALAVSAPSVWQQTTGSALTTALRNAGGLTQIVPTTNLYSATDEIVQPQVSNSPLDSSYLFNGKNVQAQAVCGPLFVIDHAGSLTSQFSYVVGRSALRSTTGQARSADYGITDCNPLPANDLTPEQKVAAAALLAPAAAAIVAGPKQNCEPDLMPYARPFAVGKRTCSGIVTPGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 69 - DNA, 38 bp, Artificial Sequence
  Artificial Sequence
agaggtaattaaatggatgcggaatttcgccatgatag

SEQ ID NO: 70 - DNA, 30 bp, Artificial Sequence
  Artificial Sequence
tgcaagagaatttcccaccacgccgcccac

SEQ ID NO: 71 - DNA, 939 bp, Artificial Sequence
  Artificial Sequence
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatggatgcggaatttcgccatgatagcggctatgaagtgcatcatcagaaactggtgttttttgcggaagatgtgggcagcaacaaaggcgcgattattggcctgatggtgggcggcgtggtgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 72 - DNA, 780 bp, Artificial Sequence
  Artificial Sequence
atggatgcggaatttcgccatgatagcggctatgaagtgcatcatcagaaactggtgttttttgcggaagatgtgggcagcaacaaaggcgcgattattggcctgatggtgggcggcgtggtgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 73 - protein, 259 aa, Artificial Sequence
  Artificial Sequence
MDAEFRHDSGYEVHHQKLVFFAEDVGSNKGAIIGLMVGGVVGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 74 - DNA, 945 bp, Artificial Sequence
  Artificial Sequence
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatggatgcggaatttcgccatgatagcggctatgaagtgcatcatcagaaactggtgttttttgcggaagatgtgggcagcaacaaaggcgcgattattggcctgatggtgggcggcgtggtgatcgcgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 75 - DNA, 786 bp, Artificial Sequence
  Artificial Sequence
atggatgcggaatttcgccatgatagcggctatgaagtgcatcatcagaaactggtgttttttgcggaagatgtgggcagcaacaaaggcgcgattattggcctgatggtgggcggcgtggtgatcgcgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 76 - protein, 261 aa, Artificial Sequence
  Artificial Sequence
MDAEFRHDSGYEVHHQKLVFFAEDVGSNKGAIIGLMVGGVVIAGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 77 - DNA, 34 bp, Artificial Sequence
  Artificial Sequence
agaggtaattaaatgggcagcagccatcatcatc

SEQ ID NO: 78 - DNA, 35 bp, Artificial Sequence
  Artificial Sequence
tgcaagagaatttccgtctactttcggcgcctgag

SEQ ID NO: 79 - DNA, 1032 bp, Artificial Sequence
  Artificial Sequence
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgggcagcagccatcatcatcatcatcacctgcaggtagataacaaattcaacaaagaaatggcgagtgcgggtggggagatcgtttatttacctaacttaaacccggatcaactgtgcgccttcatccatagtttacatgatgacccaagccaaagcgctaacttgctagcagaagctaaaaagctaaatgatgctcaggcgccgaaagtagacggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 80 - DNA, 873 bp, Artificial Sequence
  Artificial Sequence
atgggcagcagccatcatcatcatcatcacctgcaggtagataacaaattcaacaaagaaatggcgagtgcgggtggggagatcgtttatttacctaacttaaacccggatcaactgtgcgccttcatccatagtttacatgatgacccaagccaaagcgctaacttgctagcagaagctaaaaagctaaatgatgctcaggcgccgaaagtagacggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 81 - protein, 290 aa, Artificial Sequence
  Artificial Sequence
MGSSHHHHHHLQVDNKFNKEMASAGGEIVYLPNLNPDQLCAFIHSLHDDPSQSANLLAEAKKLNDAQAPKVDGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 82 - DNA, 35 bp, Artificial Sequence
  Artificial Sequence
agaggtaattaaatgcatggcgaaggtacctttac

SEQ ID NO: 83 - DNA, 28 bp, Artificial Sequence
  Artificial Sequence
tgcaagagaatttccagacggcggcggg

SEQ ID NO: 84 - DNA, 936 bp, Artificial Sequence
  Artificial Sequence
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgcatggcgaaggtacctttacgagtgatctgagcaaacagatggaagaagaagcggtgcgtctgttcattgaatggctgaaaaacggcggtccgagctctggcgccccgccgccgtctggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 85 - DNA, 777 bp, Artificial Sequence
  Artificial Sequence
atgcatggcgaaggtacctttacgagtgatctgagcaaacagatggaagaagaagcggtgcgtctgttcattgaatggctgaaaaacggcggtccgagctctggcgccccgccgccgtctggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 86 - protein, 258 aa, Artificial Sequence
  Artificial Sequence
MHGEGTFTSDLSKQMEEEAVRLFIEWLKNGGPSSGAPPPSGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 87 - DNA, 35 bp, Artificial Sequence
  Artificial Sequence
agaggtaattaaatgtataccagcctgattcattc

SEQ ID NO: 88 - DNA, 36 bp, Artificial Sequence
  Artificial Sequence
tgcaagagaatttccaaaccagttccacaggctcgc

SEQ ID NO: 89 - DNA, 927 bp, Artificial Sequence
  Artificial Sequence
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgtataccagcctgattcattctctgatcgaagaaagtcagaaccagcaagagaaaaacgaacaagaactgctggaactggataaatgggcgagcctgtggaactggtttggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 90 - DNA, 768 bp, Artificial Sequence
  Artificial Sequence
atgtataccagcctgattcattctctgatcgaagaaagtcagaaccagcaagagaaaaacgaacaagaactgctggaactggataaatgggcgagcctgtggaactggtttggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 91 - protein, 255 aa, Artificial Sequence
  Artificial Sequence
MYTSLIHSLIEESQNQQEKNEQELLELDKWASLWNWFGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 92 - DNA, 29 bp, Artificial Sequence
  Artificial Sequence
agaggtaattaaatgtgcggcaacctgag

SEQ ID NO: 93 - DNA, 915 bp, Artificial Sequence
  Artificial Sequence
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgtgcggcaacctgagcacctgtatgctgggtacctatacgcaggattttaataaattccatacctttccgcagacggcgattggcgtgggtgccccgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 94 - DNA, 756 bp, Artificial Sequence
  Artificial Sequence
atgtgcggcaacctgagcacctgtatgctgggtacctatacgcaggattttaataaattccatacctttccgcagacggcgattggcgtgggtgccccgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 95 - protein, 251 aa, Artificial Sequence
  Artificial Sequence
MCGNLSTCMLGTYTQDFNKFHTFPQTAIGVGAPGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 96 - DNA, 33 bp, Artificial Sequence
  Artificial Sequence
agaggtaattaaatgtgcagcaacctgtctacc

SEQ ID NO: 97 - DNA, 30 bp, Artificial Sequence
  Artificial Sequence
tgcaagagaatttcccggcgtaccgctgcc

SEQ ID NO: 98 - DNA, 915 bp, Artificial Sequence
  Artificial Sequence
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgtgcagcaacctgtctacctgtgtgctgggcaaactgagtcaggaactgcataaactgcagacctatccgcgtaccaatacgggcagcggtacgccgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 99 - DNA, 756 bp, Artificial Sequence
  Artificial Sequence
atgtgcagcaacctgtctacctgtgtgctgggcaaactgagtcaggaactgcataaactgcagacctatccgcgtaccaatacgggcagcggtacgccgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 100 - protein, 251 aa, Artificial Sequence
  Artificial Sequence
MCSNLSTCVLGKLSQELHKLQTYPRTNTGSGTPGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 101 - DNA, 33 bp, Artificial Sequence
  Artificial Sequence
agaggtaattaaatgagcgaagaaccgccgatt

SEQ ID NO: 102 - DNA, 43 bp, Artificial Sequence
  Artificial Sequence
tgcaagagaatttccgataatttccatcagtttacggttgctg

SEQ ID NO: 103 - DNA, 942 bp, Artificial Sequence
  Artificial Sequence
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgagcgaagaaccgccgatttctctggatctgacctttcatctgctgcgtgaagtgctggaaatggcacgtgcagaacagctggcacagcaggcgcacagcaaccgtaaactgatggaaattatcggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 104 - DNA, 783 bp, Artificial Sequence
  Artificial Sequence
atgagcgaagaaccgccgatttctctggatctgacctttcatctgctgcgtgaagtgctggaaatggcacgtgcagaacagctggcacagcaggcgcacagcaaccgtaaactgatggaaattatcggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 105 - protein, 260 aa, Artificial Sequence
  Artificial Sequence
MSEEPPISLDLTFHLLREVLEMARAEQLAQQAHSNRKLMEIIGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 106 - DNA, 33 bp, Artificial Sequence; identical to SEQ ID NO: 101
  Artificial Sequence

SEQ ID NO: 107 - DNA, 44 bp, Artificial Sequence
  Artificial Sequence
cggcggttcttcgctgataatttccatcagtttacggttgctgt

SEQ ID NO: 108 - DNA, 15 bp, Artificial Sequence
  Artificial Sequence
agcgaagaaccgccg

SEQ ID NO: 109 - DNA, 28 bp, Artificial Sequence
  Artificial Sequence
catttaattacctcttaaccagttaatg

SEQ ID NO: 110 - DNA, 1065 bp, Artificial Sequence
  Artificial Sequence
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgagcgaagaaccgccgatttctctggatctgacctttcatctgctgcgtgaagtgctggaaatggcacgtgcagaacagctggcacagcaggcgcacagcaaccgtaaactgatggaaattatcagcgaagaaccgccgatttctctggatctgacctttcatctgctgcgtgaagtgctggaaatggcacgtgcagaacagctggcacagcaggcgcacagcaaccgtaaactgatggaaattatcggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 111 - DNA, 906 bp, Artificial Sequence
  Artificial Sequence
atgagcgaagaaccgccgatttctctggatctgacctttcatctgctgcgtgaagtgctggaaatggcacgtgcagaacagctggcacagcaggcgcacagcaaccgtaaactgatggaaattatcagcgaagaaccgccgatttctctggatctgacctttcatctgctgcgtgaagtgctggaaatggcacgtgcagaacagctggcacagcaggcgcacagcaaccgtaaactgatggaaattatcggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 112 - protein, 301 aa, Artificial Sequence
  Artificial Sequence
MSEEPPISLDLTFHLLREVLEMARAEQLAQQAHSNRKLMEIISEEPPISLDLTFHLLREVLEMARAEQLAQQAHSNRKLMEIIGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 113 - DNA, 37 bp, Artificial Sequence
  Artificial Sequence
agaggtaattaaatgcaggacccatatgtaaaagaag

SEQ ID NO: 114 - DNA, 45 bp, Artificial Sequence
  Artificial Sequence
tgcaagagaatttccacggccatcaatacctcgaaacagcatctg

SEQ ID NO: 115 - DNA, 1245 bp, Artificial Sequence
  Artificial Sequence
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgcaggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 116 - DNA, 1086 bp, Artificial Sequence
  Artificial Sequence
atgcaggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 117 - protein, 361 aa, Artificial Sequence
  Artificial Sequence
MQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 118 - DNA, 34 bp, Artificial Sequence
  Artificial Sequence
agaggtaattaaatgcacggcacagtcattgaaa

SEQ ID NO: 119 - DNA, 44 bp, Artificial Sequence
  Artificial Sequence
tgcaagagaatttccacggccatcaatgcagcgactccttttcc

SEQ ID NO: 120 - DNA, 1230 bp, Artificial Sequence
  Artificial Sequence
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgcacggcacagtcattgaaagcctagaaagtctgaataactattttaactcaagtggcatagatgtggaagaaaagagtctcttcttggatatctggaggaactggcaaaaggatggtgacatgaaaatcctgcagagccagattatctctttctacctcagactctttgaagtcttgaaagacaatcaggccatcagcaacaacataagcgtcattgaatcacacctgattactaccttcttcagcaacagcaaggcgaaaaaggatgcattcatgagtattgccaagtttgaggtcaacaacccacaggtccagcgccaagcattcaatgagctcatccgagtggtccaccagctgttgccggaatccagcctcaggaagcggaaaaggagtcgctgcattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 121 - DNA, 1071 bp, Artificial Sequence
  Artificial Sequence
atgcacggcacagtcattgaaagcctagaaagtctgaataactattttaactcaagtggcatagatgtggaagaaaagagtctcttcttggatatctggaggaactggcaaaaggatggtgacatgaaaatcctgcagagccagattatctctttctacctcagactctttgaagtcttgaaagacaatcaggccatcagcaacaacataagcgtcattgaatcacacctgattactaccttcttcagcaacagcaaggcgaaaaaggatgcattcatgagtattgccaagtttgaggtcaacaacccacaggtccagcgccaagcattcaatgagctcatccgagtggtccaccagctgttgccggaatccagcctcaggaagcggaaaaggagtcgctgcattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 122 - protein, 356 aa, Artificial Sequence
  Artificial Sequence
MHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 123 - DNA, 34 bp, Artificial Sequence; identical to SEQ ID NO: 59
  Artificial Sequence

SEQ ID NO: 124 - DNA, 58 bp, Artificial Sequence; identical to SEQ ID NO: 61
  Artificial Sequence

SEQ ID NO: 125 - DNA, 1326 bp, Artificial Sequence
  Artificial Sequence
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgtgtgatctgccgcagactcactctctgggttctcgtcgtactctgatgctgctggctcagatgcgtcgtatctctcttttctcctgcttgaaggaccgtcatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaggaaagtttaagaagtaaggaaattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 126 - DNA, 1167 bp, Artificial Sequence
  Artificial Sequence
atgtgtgatctgccgcagactcactctctgggttctcgtcgtactctgatgctgctggctcagatgcgtcgtatctctcttttctcctgcttgaaggaccgtcatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaggaaagtttaagaagtaaggaaattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 127 - protein, 388 aa, Artificial Sequence
  Artificial Sequence
MCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 128 - DNA, 41 bp, Artificial Sequence
  Artificial Sequence
agaggtaattaaatgagtacaaaagattttaacttggattt

SEQ ID NO: 129 - DNA, 41 bp, Artificial Sequence
  Artificial Sequence
tgcaagagaatttcctttgcttacgtgaatactacaatgac

SEQ ID NO: 130 - DNA, 987 bp, Artificial Sequence
  Artificial Sequence
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgagtacaaaagattttaacttggatttggtatctgtttcgaagaaagattcaggtgcatcaccacgcattacaagtatttcgctatgtacacccggttgtaaaacaggagctctgatgggttgtaacatgaaaacagcaacttgtcattgtagtattcacgtaagcaaaggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 131 - DNA, 828 bp, Artificial Sequence
  Artificial Sequence
atgagtacaaaagattttaacttggatttggtatctgtttcgaagaaagattcaggtgcatcaccacgcattacaagtatttcgctatgtacacccggttgtaaaacaggagctctgatgggttgtaacatgaaaacagcaacttgtcattgtagtattcacgtaagcaaaggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 132 - protein, 275 aa, Artificial Sequence
  Artificial Sequence
MSTKDFNLDLVSVSKKDSGASPRITSISLCTPGCKTGALMGCNMKTATCHCSIHVSKGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 133 - DNA, 45 bp, Artificial Sequence
  Artificial Sequence
agaggtaattaaatgaaaaatctaaaatctcctcaaaaagtagag

SEQ ID NO: 134 - DNA, 34 bp, Artificial Sequence
  Artificial Sequence
tgcaagagaatttccattttctggtggaggtagt

SEQ ID NO: 135 - DNA, 1440 bp, Artificial Sequence
  Artificial Sequence
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgaaaaatctaaaatctcctcaaaaagtagaggtcgacatcatagatgacaactttatcctgaggtggaacaggagcgatgagtctgtcgggaatgtgactttttcattcgattatcaaaaaactgggatggataattggataaaattgtctgggtgtcagaatattactagtaccaaatgcaacttttcttcactcaagctgaatgtttatgaagaaattaaattgcgtataagagcagaaaaagaaaacacttcttcatggtatgaggttgactcatttacaccatttcgcaaagctcagattggtcctccagaagtacatttagaagctgaagataaggcaatagtgatacacatctctcctggaacaaaagatagtgttatgtgggctttggatggtttaagctttacatatagcttacttatctggaaaaactcttcaggtgtagaagaaaggattgaaaatatttattccagacataaaatttataaactctcaccagagactacttattgtctaaaagttaaagcagcactacttacgtcatggaaaattggtgtctatagtccagtacattgtataaagaccacagttgaaaatgaactacctccaccagaaaatggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 136 - DNA, 1281 bp, Artificial Sequence
  Artificial Sequence
atgaaaaatctaaaatctcctcaaaaagtagaggtcgacatcatagatgacaactttatcctgaggtggaacaggagcgatgagtctgtcgggaatgtgactttttcattcgattatcaaaaaactgggatggataattggataaaattgtctgggtgtcagaatattactagtaccaaatgcaacttttcttcactcaagctgaatgtttatgaagaaattaaattgcgtataagagcagaaaaagaaaacacttcttcatggtatgaggttgactcatttacaccatttcgcaaagctcagattggtcctccagaagtacatttagaagctgaagataaggcaatagtgatacacatctctcctggaacaaaagatagtgttatgtgggctttggatggtttaagctttacatatagcttacttatctggaaaaactcttcaggtgtagaagaaaggattgaaaatatttattccagacataaaatttataaactctcaccagagactacttattgtctaaaagttaaagcagcactacttacgtcatggaaaattggtgtctatagtccagtacattgtataaagaccacagttgaaaatgaactacctccaccagaaaatggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 137 - protein, 426 aa, Artificial Sequence
  Artificial Sequence
MKNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKAQIGPPEVHLEAEDKAIVIHISPGTKDSVMWALDGLSFTYSLLIWKNSSGVEERIENIYSRHKIYKLSPETTYCLKVKAALLTSWKIGVYSPVHCIKTTVENELPPPENGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 138 - DNA, 37 bp, Artificial Sequence
  Artificial Sequence
agaggtaattaaatggaaaatgaactacctccaccag

SEQ ID NO: 139 - DNA, 37 bp, Artificial Sequence
  Artificial Sequence
tgcaagagaatttcctttagaggtatttcctggtttt

SEQ ID NO: 140 - DNA, 1452 bp, Artificial Sequence
  Artificial Sequence
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatggaaaatgaactacctccaccagaaaatatagaagtcagtgtccaaaatcagaactatgttcttaaatgggattatacatatgcaaacatgacctttcaagttcagtggctccacgcctttttaaaaaggaatcctggaaaccatttgtataaatggaaacaaatacctgactgtgaaaatgtcaaaactacccagtgtgtctttcctcaaaacgttttccaaaaaggaatttaccttctccgcgtacaagcatctgatggaaataacacatctttttggtctgaagagataaagtttgatactgaaatacaagctttcctacttcctccagtctttaacattagatcccttagtgattcattccatatctatatcggtgctccaaaacagtctggaaacacgcctgtgatccaggattatccactgatttatgaaattattttttgggaaaacacttcaaatgctgagagaaaaattatcgagaaaaaaactgatgttacagttcctaatttgaaaccactgactgtatattgtgtgaaagccagagcacacaccatggatgaaaagctgaataaaagcagtgtttttagtgacgctgtatgtgagaaaacaaaaccaggaaatacctctaaaggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 141 - DNA, 1293 bp, Artificial Sequence
  Artificial Sequence
atggaaaatgaactacctccaccagaaaatatagaagtcagtgtccaaaatcagaactatgttcttaaatgggattatacatatgcaaacatgacctttcaagttcagtggctccacgcctttttaaaaaggaatcctggaaaccatttgtataaatggaaacaaatacctgactgtgaaaatgtcaaaactacccagtgtgtctttcctcaaaacgttttccaaaaaggaatttaccttctccgcgtacaagcatctgatggaaataacacatctttttggtctgaagagataaagtttgatactgaaatacaagctttcctacttcctccagtctttaacattagatcccttagtgattcattccatatctatatcggtgctccaaaacagtctggaaacacgcctgtgatccaggattatccactgatttatgaaattattttttgggaaaacacttcaaatgctgagagaaaaattatcgagaaaaaaactgatgttacagttcctaatttgaaaccactgactgtatattgtgtgaaagccagagcacacaccatggatgaaaagctgaataaaagcagtgtttttagtgacgctgtatgtgagaaaacaaaaccaggaaatacctctaaaggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 142 - protein, 430 aa, Artificial Sequence
  Artificial Sequence
MENELPPPENIEVSVQNQNYVLKWDYTYANMTFQVQWLHAFLKRNPGNHLYKWKQIPDCENVKTTQCVFPQNVFQKGIYLLRVQASDGNNTSFWSEEIKFDTEIQAFLLPPVFNIRSLSDSFHIYIGAPKQSGNTPVIQDYPLIYEIIFWENTSNAERKIIEKKTDVTVPNLKPLTVYCVKARAHTMDEKLNKSSVFSDAVCEKTKPGNTSKGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 143 - DNA, 42 bp, Artificial Sequence
  Artificial Sequence
agaggtaattaaatggcatttgatggcacttggaaagtagac

SEQ ID NO: 144 - DNA, 51 bp, Artificial Sequence
  Artificial Sequence
tgcaagagaatttccacggccatcaatttccttcttaaagatccgcttggc

SEQ ID NO: 145 - DNA, 1224 bp, Artificial Sequence
  Artificial Sequence
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatggcatttgatggcacttggaaagtagaccggaatgagaactatgaaaagttcatggagaaaatgggcattaacgtggtgaagaggaagcttggagctcatgacaacttgaaactgacgatcacacaggaaggaaataaattcacagtcaaagaatcaagcaacttccgaaacattgatgttgtgtttgaactcggcgtcgactttgcctatagtctagcagatggaacagaactcactgggacctggaccatggagggaaataaacttgttggaaaattcaaacgtgtagacaatggaaaggagctgattgctgtccgagagatttctggtaacgaactaatccaaacctacacatatgaaggagtggaggccaagcggatctttaagaaggaaattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 146 - DNA, 1065 bp, Artificial Sequence
  Artificial Sequence
atggcatttgatggcacttggaaagtagaccggaatgagaactatgaaaagttcatggagaaaatgggcattaacgtggtgaagaggaagcttggagctcatgacaacttgaaactgacgatcacacaggaaggaaataaattcacagtcaaagaatcaagcaacttccgaaacattgatgttgtgtttgaactcggcgtcgactttgcctatagtctagcagatggaacagaactcactgggacctggaccatggagggaaataaacttgttggaaaattcaaacgtgtagacaatggaaaggagctgattgctgtccgagagatttctggtaacgaactaatccaaacctacacatatgaaggagtggaggccaagcggatctttaagaaggaaattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 147 - protein, 354 aa, Artificial Sequence
  Artificial Sequence
MAFDGTWKVDRNENYEKFMEKMGINVVKRKLGAHDNLKLTITQEGNKFTVKESSNFRNIDVVFELGVDFAYSLADGTELTGTWTMEGNKLVGKFKRVDNGKELIAVREISGNELIQTYTYEGVEAKRIFKKEIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 148 - protein, 354 aa, Artificial Sequence
  Artificial Sequence
MAFDGTWKVDRNENYEKFMEKMGINVVKRKLGAHDNLKLTITQEGNKFTVKESSNFRNIDVVFELGVDFAYSLADGTELTVTWTMEGNKLVGKFKRVDNGKELIAVREISGNELIQTYTYEGVEAKRIFKKEIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 149 - protein, 354 aa, Artificial Sequence
  Artificial Sequence
MAFDGTWKVDRNENYEKFMEKMGINVVKRKLGAHDNLKLTITQEGNKFTVKESSNFRNIDVVFELGVDFAYSLADGTELTGTWTMEGNKLVGKFKRVDNGKELIAVREISGNELIQTYTYEVVEAKRIFKKEIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 150 - protein, 354 aa, Artificial Sequence
  Artificial Sequence
MAFDGTWKVDRNENYEKFMEKMGINVVKRKLGAHDNLKLTITQEGNKFTVKESSNFRNIDVVFELGVDFAYSLADGTELTVTWTMEGNKLVGKFKRVDNGKELIAVREISGNELIQTYTYEVVEAKRIFKKEIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 151 - DNA, 28 bp, Artificial Sequence
  Alzheimer peptide binding protein
tgcaagagaatttcccggggcacccacg

SEQ ID NO: 152 - DNA, 42 bp, Artificial Sequence; identical to SEQ ID NO: 143
  Artificial Sequence

SEQ ID NO: 153 - DNA, 51 bp, Artificial Sequence; identical to SEQ ID NO: 144
  Artificial Sequence

SEQ ID NO: 154 - DNA, 816 bp, Artificial Sequence
  Artificial Sequence
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagca

SEQ ID NO: 155 - DNA, 38 bp, Artificial Sequence; identical to SEQ ID NO: 69
  AGAGGTAATTAAATGGATGCGGAATTTCGCCATGATAG

SEQ ID NO: 156 - DNA, 31 bp, Artificial Sequence
  TGCAAGAGAATTTCCCGCGATCACCACGCCG
tgcaagagaatttcccgcgatcaccacgccg

SEQ ID NO: 157 - protein, 1024 aa, Artificial Sequence; identical to SEQ ID NO: 41
  JOURNAL OF BIOLOGICAL CHEMISTRY VOL. 282, NO. 43, pp. 31477�31483

SEQ ID NO: 158 - DNA, 513 bp, Escherichia coli
atgaatataaacaaaccattagagattcttgggcatgtatcctggctatgggccagttctccactacacagaaactggccagtatctttgtttgcaataaatgtattacccgcaatacaggctaaccaatatgttttattaacccgggatgattaccctgtcgcgtattgtagttgggctaatttaagtttagaaaatgaaattaaatatcttaatgatgttacctcattagttgcagaagactggacttcaggtgatcgtaaatggttcattgactggattgctcctttcggggataacggtgccctgtacaaatatatgcgaaaaaaattccctgatgaactattcagagccatcagggtggatcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaa

SEQ ID NO: 159 - DNA, 524 bp, Escherichia coli
atgaatataaacaaaccattagagattcttgggcatgtatcctggctatgggccagttctccactacacagaaactggccagtatctttgtttgcaataaatgtattacccgcaatacaggctaaccaatatgctttattaatccgggatgattaccctgtcgcgtattgtagttgggctaatttaagtttggaaaatgaaattaaatatcttaatgatgttacctcattagttgcagaagactggacttcaggtgatcgtaaatggttcattgactggattgctcctttcggggataacggtgccctgtacaaatatatgcgaaaaaaattccctgatgaactattcagagccatcagggtggatcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaa

SEQ ID NO: 160 - DNA, 15 bp, Artificial
  Primer elongation sequence for cloning into pSU HlyA1 vector
agaggtaattaaatg

SEQ ID NO: 161 - DNA, 15 bp, Artificial
  Primer elongation sequence for cloning into pSU HlyA1 vector
tgcaagagaatttcc

SEQ ID NO: 162 - DNA, 19 bp, Artificial
  Oligonucleotide primer
gctcgaattcgtaatcatg

SEQ ID NO: 163 - DNA, 22 bp, Artificial
  Oligonucleotide primer
attaaatgggaaattctcttgc

SEQ ID NO: 164 - DNA, 24 bp, Artificial
  Oligonucleotide primer
gtaattaaatgggaaattctcttg

SEQ ID NO: 165 - DNA, 22 bp, Artificial
  Oligonucleotide primer
ggttaagaggtaattaaatggg

SEQ ID NO: 166 - DNA, 26 bp, Artificial
  Oligonucleotide primer
ttaactggttaagaggtaattaaatg

SEQ ID NO: 167 - DNA, 24 bp, Artificial
  Oligonucleotide primer
aatttttcattaactggttaagag

SEQ ID NO: 168 - DNA, 26 bp, Artificial
  Oligonucleotide primer
tcagattttaatttttcattaactgg

SEQ ID NO: 169 - DNA, 24 bp, Artificial
  Oligonucleotide primer
ataactgaagtaaaaagaaagtca

SEQ ID NO: 170 - DNA, 21 bp, Artificial
  Oligonucleotide primer
aaacaatatcaccacgagtta

SEQ ID NO: 171 - DNA, 25 bp, Artificial
  Oligonucleotide primer
cagttagcgaataaaatttttaaac

SEQ ID NO: 172 - DNA, 24 bp, Artificial
  Oligonucleotide Primer
atgattacgaattcgagctcccaa

SEQ ID NO: 173 - DNA, 14 bp, Artificial
  Oligonucleotide primer
ccaacgcgcgggga

SEQ ID NO: 174 - DNA, 39 bp, Artificial
  Oligonucleotide primer
caggaaacagctatgacattattacgaattcgagcatgg

SEQ ID NO: 175 - DNA, 39 bp, Artificial
  Oligonucleotide primer
ccatgctcgaattcgtaataatgtcatagctgtttcctg

SEQ ID NO: 176 - DNA, 4386 bp, Artificial
  modified pSU expression vector
tgattacgaattcgagcatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 177 - DNA, 4386 bp, Artificial
  modified pSU expression vector
ttattacgaattcgagcatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 178 - DNA, 4391 bp, Artificial
  modified pSU expression vector
tgattacgaattcgagcattaaatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 179 - DNA, 4394 bp, Artificial
  modified pSU expression vector
tgattacgaattcgagcgtaattaaatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 180 - DNA, 4397 bp, Artificial
  modified pSU expression vector
tgattacgaattcgagcgaggtaattaaatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 181 - DNA, 4403 bp, Artificial
  modified pSU expression vector
tgattacgaattcgagcggttaagaggtaattaaatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 182 - DNA, 4409 bp, Artificial
  modified pSU expression vector
tgattacgaattcgagcttaactggttaagaggtaattaaatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 183 - DNA, 4418 bp, Artificial
  modified pSU expression vector
tgattacgaattcgagcaatttttcattaactggttaagaggtaattaaatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 184 - DNA, 4427 bp, Artificial
  modified pSU expression vector
tgattacgaattcgagctcagattttaatttttcattaactggttaagaggtaattaaatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 185 - DNA, 4448 bp, Artificial
  modified pSU expression vector
tgattacgaattcgagcataactgaagtaaaaagaaagtcagattttaatttttcattaactggttaagaggtaattaaatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 186 - DNA, 4469 bp, Artificial
  modified pSU expression vector
tgattacgaattcgagcaaacaatatcaccacgagttaataactgaagtaaaaagaaagtcagattttaatttttcattaactggttaagaggtaattaaatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 187 - DNA, 4490 bp, Artificial
  modified pSU expression vector
tgattacgaattcgagccagttagcgaataaaatttttaaacaatatcaccacgagttaataactgaagtaaaaagaaagtcagattttaatttttcattaactggttaagaggtaattaaatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 188 - DNA, 6801 bp, Artificial
  modified pSU expression vector
tgattacgaattcgagcatgacaacaataaccactgcacaaattaaaagcacactgcagtctgcaaagcaatccgctgcaaataaattgcactcagcaggacaaagcacgaaagatgcattaaaaaaagcagcagagcaaacccgcaatgcgggaaacagactcattttacttatccctaaagattataaaggacagggttcaagccttaatgaccttgtcaggacggcagatgaactgggaattgaagtccagtatgatgaaaagaatggcacggcgattactaaacaggtgttcggcacagcagagaaactcattggcctcaccgaacggggagtgactatctttgcaccacaattagacaaattactgcaaaagtatcaaaaagcaggtaatatattaggtggcggtgctgaaaatatcggtgataacttaggaaaggcaggcggtatattgtcaacgtttcaaaatttcctgggtactgcactttcctcaatgaaaatagacgaactgataaagaaacaaaaatctggtggcaatgtcagttcttctgagatggcagaagcgagtattgagctaatcaatcaacttgtggatacagttgccagccttaataataatgttaactcattttctcaacaactcaatactctgggaagtgtattatccaatacaaagcacctgaacggtgttggtaataagttacagaatttacctaatcttgataatatcggtgcagggttagatactgtatcgggtattttatctgcgatttcagcaagcttcattctgagcaatgcagatgcagataccagaactaaagctgcagcaggtgttgaattaacaacgaaagtactgggtaatgttggaaaaggtatttctcaatatattatcgcacagcgcgctgcacaggggttatctacatctgctgctgctgccggtttaattgcttctgctgtgacactagcaattagtcccctctcattcctgtccattgccgataagtttaaacgtgccaataaaatagaggagtattcacaacgattcaaaaaacttggatacgatggtgacagtttacttgctgctttccacaaagaaacaggggctattgatgcatcattaacaacgataagcactgtactggcttcagtatcttcaggtattagtgctgctgcaacgacatctctggttggtgcaccggtaagcgcgctggtaggcgctgttacggggataatttcaggtatccttgaggcttcaaagcaggcaatgtttgaacatgttgccagtaaaatggctgatgttattgctgaatgggagaaaaaacacggcaaaaattactttgaaaatggatatgatgcccgccatgctgcatttttagaagataactttaaaatattatctcagtataataaagagtattctgttgaaagatcagtcctcattacccagcaacattgggatacgctgataggtgagttagctggtgtcaccagaaatggagacaaaacactcagtggtaaaagttatattgactattatgaagaaggaaaacgtctggagaaaaaaccggatgaattccagaagcaagtctttgacccattgaaaggaaatattgacctttctgacagcaaatcttctacgttattgaaatttgttacgccattattaactcccggtgaggaaattcgtgaaaggaggcagtccggaaaatatgaatatattaccgagttattagtcaagggtgttgataaatggacggtgaagggggttcaggacaagggggctgtatatgattactctaacctgattcagcatgcatcagtcggtaataaccagtatcgggaaatccgtattgagtcacacctgggagacggggatgataaggtctttttatctgccggctcagccaatatctacgcaggtaaaggacatgatgttgtttattatgataaaacagacactggttatctgaccattgatggcacaaaagcaaccgaagcgggtaattacacggtaacacgtgtacttggtggcgatgttaaggttttacaggaagttgtgaaggagcaggaggtttcagtcggaaaaagaactgaaaaaacgcaatatcggagttatgaattcactcatatcaatggtaaaaatttaacagagactgataacttatattccgtggaagaacttattgggaccacgcgtgccgacaagttttttggcagtaaatttactgatatcttccatggcgcggatggtgatgaccttatagaaggaaatgatgggaatgaccgcttatatggtgataaaggtaatgacacactgagtggtggaaacggagatgaccagctctatggcggtgatggtaacgataagttgattgggggagcaggtaataattacctgaacggcggagatggagatgatgagcttcaggttcagggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 189 - DNA, 6812 bp, Artificial
  modified pSU expression vector
tgattacgaattcgagcgaggtaattaaatgacaacaataaccactgcacaaattaaaagcacactgcagtctgcaaagcaatccgctgcaaataaattgcactcagcaggacaaagcacgaaagatgcattaaaaaaagcagcagagcaaacccgcaatgcgggaaacagactcattttacttatccctaaagattataaaggacagggttcaagccttaatgaccttgtcaggacggcagatgaactgggaattgaagtccagtatgatgaaaagaatggcacggcgattactaaacaggtgttcggcacagcagagaaactcattggcctcaccgaacggggagtgactatctttgcaccacaattagacaaattactgcaaaagtatcaaaaagcaggtaatatattaggtggcggtgctgaaaatatcggtgataacttaggaaaggcaggcggtatattgtcaacgtttcaaaatttcctgggtactgcactttcctcaatgaaaatagacgaactgataaagaaacaaaaatctggtggcaatgtcagttcttctgagatggcagaagcgagtattgagctaatcaatcaacttgtggatacagttgccagccttaataataatgttaactcattttctcaacaactcaatactctgggaagtgtattatccaatacaaagcacctgaacggtgttggtaataagttacagaatttacctaatcttgataatatcggtgcagggttagatactgtatcgggtattttatctgcgatttcagcaagcttcattctgagcaatgcagatgcagataccagaactaaagctgcagcaggtgttgaattaacaacgaaagtactgggtaatgttggaaaaggtatttctcaatatattatcgcacagcgcgctgcacaggggttatctacatctgctgctgctgccggtttaattgcttctgctgtgacactagcaattagtcccctctcattcctgtccattgccgataagtttaaacgtgccaataaaatagaggagtattcacaacgattcaaaaaacttggatacgatggtgacagtttacttgctgctttccacaaagaaacaggggctattgatgcatcattaacaacgataagcactgtactggcttcagtatcttcaggtattagtgctgctgcaacgacatctctggttggtgcaccggtaagcgcgctggtaggcgctgttacggggataatttcaggtatccttgaggcttcaaagcaggcaatgtttgaacatgttgccagtaaaatggctgatgttattgctgaatgggagaaaaaacacggcaaaaattactttgaaaatggatatgatgcccgccatgctgcatttttagaagataactttaaaatattatctcagtataataaagagtattctgttgaaagatcagtcctcattacccagcaacattgggatacgctgataggtgagttagctggtgtcaccagaaatggagacaaaacactcagtggtaaaagttatattgactattatgaagaaggaaaacgtctggagaaaaaaccggatgaattccagaagcaagtctttgacccattgaaaggaaatattgacctttctgacagcaaatcttctacgttattgaaatttgttacgccattattaactcccggtgaggaaattcgtgaaaggaggcagtccggaaaatatgaatatattaccgagttattagtcaagggtgttgataaatggacggtgaagggggttcaggacaagggggctgtatatgattactctaacctgattcagcatgcatcagtcggtaataaccagtatcgggaaatccgtattgagtcacacctgggagacggggatgataaggtctttttatctgccggctcagccaatatctacgcaggtaaaggacatgatgttgtttattatgataaaacagacactggttatctgaccattgatggcacaaaagcaaccgaagcgggtaattacacggtaacacgtgtacttggtggcgatgttaaggttttacaggaagttgtgaaggagcaggaggtttcagtcggaaaaagaactgaaaaaacgcaatatcggagttatgaattcactcatatcaatggtaaaaatttaacagagactgataacttatattccgtggaagaacttattgggaccacgcgtgccgacaagttttttggcagtaaatttactgatatcttccatggcgcggatggtgatgaccttatagaaggaaatgatgggaatgaccgcttatatggtgataaaggtaatgacacactgagtggtggaaacggagatgaccagctctatggcggtgatggtaacgataagttgattgggggagcaggtaataattacctgaacggcggagatggagatgatgagcttcaggttcagggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 190 - DNA, 6842 bp, Artificial
  modified pSU expression vector
tgattacgaattcgagctcagattttaatttttcattaactggttaagaggtaattaaatgacaacaataaccactgcacaaattaaaagcacactgcagtctgcaaagcaatccgctgcaaataaattgcactcagcaggacaaagcacgaaagatgcattaaaaaaagcagcagagcaaacccgcaatgcgggaaacagactcattttacttatccctaaagattataaaggacagggttcaagccttaatgaccttgtcaggacggcagatgaactgggaattgaagtccagtatgatgaaaagaatggcacggcgattactaaacaggtgttcggcacagcagagaaactcattggcctcaccgaacggggagtgactatctttgcaccacaattagacaaattactgcaaaagtatcaaaaagcaggtaatatattaggtggcggtgctgaaaatatcggtgataacttaggaaaggcaggcggtatattgtcaacgtttcaaaatttcctgggtactgcactttcctcaatgaaaatagacgaactgataaagaaacaaaaatctggtggcaatgtcagttcttctgagatggcagaagcgagtattgagctaatcaatcaacttgtggatacagttgccagccttaataataatgttaactcattttctcaacaactcaatactctgggaagtgtattatccaatacaaagcacctgaacggtgttggtaataagttacagaatttacctaatcttgataatatcggtgcagggttagatactgtatcgggtattttatctgcgatttcagcaagcttcattctgagcaatgcagatgcagataccagaactaaagctgcagcaggtgttgaattaacaacgaaagtactgggtaatgttggaaaaggtatttctcaatatattatcgcacagcgcgctgcacaggggttatctacatctgctgctgctgccggtttaattgcttctgctgtgacactagcaattagtcccctctcattcctgtccattgccgataagtttaaacgtgccaataaaatagaggagtattcacaacgattcaaaaaacttggatacgatggtgacagtttacttgctgctttccacaaagaaacaggggctattgatgcatcattaacaacgataagcactgtactggcttcagtatcttcaggtattagtgctgctgcaacgacatctctggttggtgcaccggtaagcgcgctggtaggcgctgttacggggataatttcaggtatccttgaggcttcaaagcaggcaatgtttgaacatgttgccagtaaaatggctgatgttattgctgaatgggagaaaaaacacggcaaaaattactttgaaaatggatatgatgcccgccatgctgcatttttagaagataactttaaaatattatctcagtataataaagagtattctgttgaaagatcagtcctcattacccagcaacattgggatacgctgataggtgagttagctggtgtcaccagaaatggagacaaaacactcagtggtaaaagttatattgactattatgaagaaggaaaacgtctggagaaaaaaccggatgaattccagaagcaagtctttgacccattgaaaggaaatattgacctttctgacagcaaatcttctacgttattgaaatttgttacgccattattaactcccggtgaggaaattcgtgaaaggaggcagtccggaaaatatgaatatattaccgagttattagtcaagggtgttgataaatggacggtgaagggggttcaggacaagggggctgtatatgattactctaacctgattcagcatgcatcagtcggtaataaccagtatcgggaaatccgtattgagtcacacctgggagacggggatgataaggtctttttatctgccggctcagccaatatctacgcaggtaaaggacatgatgttgtttattatgataaaacagacactggttatctgaccattgatggcacaaaagcaaccgaagcgggtaattacacggtaacacgtgtacttggtggcgatgttaaggttttacaggaagttgtgaaggagcaggaggtttcagtcggaaaaagaactgaaaaaacgcaatatcggagttatgaattcactcatatcaatggtaaaaatttaacagagactgataacttatattccgtggaagaacttattgggaccacgcgtgccgacaagttttttggcagtaaatttactgatatcttccatggcgcggatggtgatgaccttatagaaggaaatgatgggaatgaccgcttatatggtgataaaggtaatgacacactgagtggtggaaacggagatgaccagctctatggcggtgatggtaacgataagttgattgggggagcaggtaataattacctgaacggcggagatggagatgatgagcttcaggttcagggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 191 - DNA, 6863 bp, Artificial
  modified pSU expression vector
tgattacgaattcgagcataactgaagtaaaaagaaagtcagattttaatttttcattaactggttaagaggtaattaaatgacaacaataaccactgcacaaattaaaagcacactgcagtctgcaaagcaatccgctgcaaataaattgcactcagcaggacaaagcacgaaagatgcattaaaaaaagcagcagagcaaacccgcaatgcgggaaacagactcattttacttatccctaaagattataaaggacagggttcaagccttaatgaccttgtcaggacggcagatgaactgggaattgaagtccagtatgatgaaaagaatggcacggcgattactaaacaggtgttcggcacagcagagaaactcattggcctcaccgaacggggagtgactatctttgcaccacaattagacaaattactgcaaaagtatcaaaaagcaggtaatatattaggtggcggtgctgaaaatatcggtgataacttaggaaaggcaggcggtatattgtcaacgtttcaaaatttcctgggtactgcactttcctcaatgaaaatagacgaactgataaagaaacaaaaatctggtggcaatgtcagttcttctgagatggcagaagcgagtattgagctaatcaatcaacttgtggatacagttgccagccttaataataatgttaactcattttctcaacaactcaatactctgggaagtgtattatccaatacaaagcacctgaacggtgttggtaataagttacagaatttacctaatcttgataatatcggtgcagggttagatactgtatcgggtattttatctgcgatttcagcaagcttcattctgagcaatgcagatgcagataccagaactaaagctgcagcaggtgttgaattaacaacgaaagtactgggtaatgttggaaaaggtatttctcaatatattatcgcacagcgcgctgcacaggggttatctacatctgctgctgctgccggtttaattgcttctgctgtgacactagcaattagtcccctctcattcctgtccattgccgataagtttaaacgtgccaataaaatagaggagtattcacaacgattcaaaaaacttggatacgatggtgacagtttacttgctgctttccacaaagaaacaggggctattgatgcatcattaacaacgataagcactgtactggcttcagtatcttcaggtattagtgctgctgcaacgacatctctggttggtgcaccggtaagcgcgctggtaggcgctgttacggggataatttcaggtatccttgaggcttcaaagcaggcaatgtttgaacatgttgccagtaaaatggctgatgttattgctgaatgggagaaaaaacacggcaaaaattactttgaaaatggatatgatgcccgccatgctgcatttttagaagataactttaaaatattatctcagtataataaagagtattctgttgaaagatcagtcctcattacccagcaacattgggatacgctgataggtgagttagctggtgtcaccagaaatggagacaaaacactcagtggtaaaagttatattgactattatgaagaaggaaaacgtctggagaaaaaaccggatgaattccagaagcaagtctttgacccattgaaaggaaatattgacctttctgacagcaaatcttctacgttattgaaatttgttacgccattattaactcccggtgaggaaattcgtgaaaggaggcagtccggaaaatatgaatatattaccgagttattagtcaagggtgttgataaatggacggtgaagggggttcaggacaagggggctgtatatgattactctaacctgattcagcatgcatcagtcggtaataaccagtatcgggaaatccgtattgagtcacacctgggagacggggatgataaggtctttttatctgccggctcagccaatatctacgcaggtaaaggacatgatgttgtttattatgataaaacagacactggttatctgaccattgatggcacaaaagcaaccgaagcgggtaattacacggtaacacgtgtacttggtggcgatgttaaggttttacaggaagttgtgaaggagcaggaggtttcagtcggaaaaagaactgaaaaaacgcaatatcggagttatgaattcactcatatcaatggtaaaaatttaacagagactgataacttatattccgtggaagaacttattgggaccacgcgtgccgacaagttttttggcagtaaatttactgatatcttccatggcgcggatggtgatgaccttatagaaggaaatgatgggaatgaccgcttatatggtgataaaggtaatgacacactgagtggtggaaacggagatgaccagctctatggcggtgatggtaacgataagttgattgggggagcaggtaataattacctgaacggcggagatggagatgatgagcttcaggttcagggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 192 - DNA, 6884 bp, Artificial
  modified pSU expression vector
tgattacgaattcgagcaaacaatatcaccacgagttaataactgaagtaaaaagaaagtcagattttaatttttcattaactggttaagaggtaattaaatgacaacaataaccactgcacaaattaaaagcacactgcagtctgcaaagcaatccgctgcaaataaattgcactcagcaggacaaagcacgaaagatgcattaaaaaaagcagcagagcaaacccgcaatgcgggaaacagactcattttacttatccctaaagattataaaggacagggttcaagccttaatgaccttgtcaggacggcagatgaactgggaattgaagtccagtatgatgaaaagaatggcacggcgattactaaacaggtgttcggcacagcagagaaactcattggcctcaccgaacggggagtgactatctttgcaccacaattagacaaattactgcaaaagtatcaaaaagcaggtaatatattaggtggcggtgctgaaaatatcggtgataacttaggaaaggcaggcggtatattgtcaacgtttcaaaatttcctgggtactgcactttcctcaatgaaaatagacgaactgataaagaaacaaaaatctggtggcaatgtcagttcttctgagatggcagaagcgagtattgagctaatcaatcaacttgtggatacagttgccagccttaataataatgttaactcattttctcaacaactcaatactctgggaagtgtattatccaatacaaagcacctgaacggtgttggtaataagttacagaatttacctaatcttgataatatcggtgcagggttagatactgtatcgggtattttatctgcgatttcagcaagcttcattctgagcaatgcagatgcagataccagaactaaagctgcagcaggtgttgaattaacaacgaaagtactgggtaatgttggaaaaggtatttctcaatatattatcgcacagcgcgctgcacaggggttatctacatctgctgctgctgccggtttaattgcttctgctgtgacactagcaattagtcccctctcattcctgtccattgccgataagtttaaacgtgccaataaaatagaggagtattcacaacgattcaaaaaacttggatacgatggtgacagtttacttgctgctttccacaaagaaacaggggctattgatgcatcattaacaacgataagcactgtactggcttcagtatcttcaggtattagtgctgctgcaacgacatctctggttggtgcaccggtaagcgcgctggtaggcgctgttacggggataatttcaggtatccttgaggcttcaaagcaggcaatgtttgaacatgttgccagtaaaatggctgatgttattgctgaatgggagaaaaaacacggcaaaaattactttgaaaatggatatgatgcccgccatgctgcatttttagaagataactttaaaatattatctcagtataataaagagtattctgttgaaagatcagtcctcattacccagcaacattgggatacgctgataggtgagttagctggtgtcaccagaaatggagacaaaacactcagtggtaaaagttatattgactattatgaagaaggaaaacgtctggagaaaaaaccggatgaattccagaagcaagtctttgacccattgaaaggaaatattgacctttctgacagcaaatcttctacgttattgaaatttgttacgccattattaactcccggtgaggaaattcgtgaaaggaggcagtccggaaaatatgaatatattaccgagttattagtcaagggtgttgataaatggacggtgaagggggttcaggacaagggggctgtatatgattactctaacctgattcagcatgcatcagtcggtaataaccagtatcgggaaatccgtattgagtcacacctgggagacggggatgataaggtctttttatctgccggctcagccaatatctacgcaggtaaaggacatgatgttgtttattatgataaaacagacactggttatctgaccattgatggcacaaaagcaaccgaagcgggtaattacacggtaacacgtgtacttggtggcgatgttaaggttttacaggaagttgtgaaggagcaggaggtttcagtcggaaaaagaactgaaaaaacgcaatatcggagttatgaattcactcatatcaatggtaaaaatttaacagagactgataacttatattccgtggaagaacttattgggaccacgcgtgccgacaagttttttggcagtaaatttactgatatcttccatggcgcggatggtgatgaccttatagaaggaaatgatgggaatgaccgcttatatggtgataaaggtaatgacacactgagtggtggaaacggagatgaccagctctatggcggtgatggtaacgataagttgattgggggagcaggtaataattacctgaacggcggagatggagatgatgagcttcaggttcagggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 193 - DNA, 6905 bp, Artificial
  modified pSU expression vector
tgattacgaattcgagccagttagcgaataaaatttttaaacaatatcaccacgagttaataactgaagtaaaaagaaagtcagattttaatttttcattaactggttaagaggtaattaaatgacaacaataaccactgcacaaattaaaagcacactgcagtctgcaaagcaatccgctgcaaataaattgcactcagcaggacaaagcacgaaagatgcattaaaaaaagcagcagagcaaacccgcaatgcgggaaacagactcattttacttatccctaaagattataaaggacagggttcaagccttaatgaccttgtcaggacggcagatgaactgggaattgaagtccagtatgatgaaaagaatggcacggcgattactaaacaggtgttcggcacagcagagaaactcattggcctcaccgaacggggagtgactatctttgcaccacaattagacaaattactgcaaaagtatcaaaaagcaggtaatatattaggtggcggtgctgaaaatatcggtgataacttaggaaaggcaggcggtatattgtcaacgtttcaaaatttcctgggtactgcactttcctcaatgaaaatagacgaactgataaagaaacaaaaatctggtggcaatgtcagttcttctgagatggcagaagcgagtattgagctaatcaatcaacttgtggatacagttgccagccttaataataatgttaactcattttctcaacaactcaatactctgggaagtgtattatccaatacaaagcacctgaacggtgttggtaataagttacagaatttacctaatcttgataatatcggtgcagggttagatactgtatcgggtattttatctgcgatttcagcaagcttcattctgagcaatgcagatgcagataccagaactaaagctgcagcaggtgttgaattaacaacgaaagtactgggtaatgttggaaaaggtatttctcaatatattatcgcacagcgcgctgcacaggggttatctacatctgctgctgctgccggtttaattgcttctgctgtgacactagcaattagtcccctctcattcctgtccattgccgataagtttaaacgtgccaataaaatagaggagtattcacaacgattcaaaaaacttggatacgatggtgacagtttacttgctgctttccacaaagaaacaggggctattgatgcatcattaacaacgataagcactgtactggcttcagtatcttcaggtattagtgctgctgcaacgacatctctggttggtgcaccggtaagcgcgctggtaggcgctgttacggggataatttcaggtatccttgaggcttcaaagcaggcaatgtttgaacatgttgccagtaaaatggctgatgttattgctgaatgggagaaaaaacacggcaaaaattactttgaaaatggatatgatgcccgccatgctgcatttttagaagataactttaaaatattatctcagtataataaagagtattctgttgaaagatcagtcctcattacccagcaacattgggatacgctgataggtgagttagctggtgtcaccagaaatggagacaaaacactcagtggtaaaagttatattgactattatgaagaaggaaaacgtctggagaaaaaaccggatgaattccagaagcaagtctttgacccattgaaaggaaatattgacctttctgacagcaaatcttctacgttattgaaatttgttacgccattattaactcccggtgaggaaattcgtgaaaggaggcagtccggaaaatatgaatatattaccgagttattagtcaagggtgttgataaatggacggtgaagggggttcaggacaagggggctgtatatgattactctaacctgattcagcatgcatcagtcggtaataaccagtatcgggaaatccgtattgagtcacacctgggagacggggatgataaggtctttttatctgccggctcagccaatatctacgcaggtaaaggacatgatgttgtttattatgataaaacagacactggttatctgaccattgatggcacaaaagcaaccgaagcgggtaattacacggtaacacgtgtacttggtggcgatgttaaggttttacaggaagttgtgaaggagcaggaggtttcagtcggaaaaagaactgaaaaaacgcaatatcggagttatgaattcactcatatcaatggtaaaaatttaacagagactgataacttatattccgtggaagaacttattgggaccacgcgtgccgacaagttttttggcagtaaatttactgatatcttccatggcgcggatggtgatgaccttatagaaggaaatgatgggaatgaccgcttatatggtgataaaggtaatgacacactgagtggtggaaacggagatgaccagctctatggcggtgatggtaacgataagttgattgggggagcaggtaataattacctgaacggcggagatggagatgatgagcttcaggttcagggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 194 - DNA, 6777 bp, Artificial
  modified pSU expression vector
tgattacgaattcgagctcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgacaacaataaccactgcacaaattaaaagcacactgcagtctgcaaagcaatccgctgcaaataaattgcactcagcaggacaaagcacgaaagatgcattaaaaaaagcagcagagcaaacccgcaatgcgggaaacagactcattttacttatccctaaagattataaaggacagggttcaagccttaatgaccttgtcaggacggcagatgaactgggaattgaagtccagtatgatgaaaagaatggcacggcgattactaaacaggtgttcggcacagcagagaaactcattggcctcaccgaacggggagtgactatctttgcaccacaattagacaaattactgcaaaagtatcaaaaagcaggtaatatattaggtggcggtgctgaaaatatcggtgataacttaggaaaggcaggcggtatattgtcaacgtttcaaaatttcctgggtactgcactttcctcaatgaaaatagacgaactgataaagaaacaaaaatctggtggcaatgtcagttcttctgagatggcagaagcgagtattgagctaatcaatcaacttgtggatacagttgccagccttaataataatgttaactcattttctcaacaactcaatactctgggaagtgtattatccaatacaaagcacctgaacggtgttggtaataagttacagaatttacctaatcttgataatatcggtgcagggttagatactgtatcgggtattttatctgcgatttcagcaagcttcattctgagcaatgcagatgcagataccagaactaaagctgcagcaggtgttgaattaacaacgaaagtactgggtaatgttggaaaaggtatttctcaatatattatcgcacagcgcgctgcacaggggttatctacatctgctgctgctgccggtttaattgcttctgctgtgacactagcaattagtcccctctcattcctgtccattgccgataagtttaaacgtgccaataaaatagaggagtattcacaacgattcaaaaaacttggatacgatggtgacagtttacttgctgctttccacaaagaaacaggggctattgatgcatcattaacaacgataagcactgtactggcttcagtatcttcaggtattagtgctgctgcaacgacatctctggttggtgcaccggtaagcgcgctggtaggcgctgttacggggataatttcaggtatccttgaggcttcaaagcaggcaatgtttgaacatgttgccagtaaaatggctgatgttattgctgaatgggagaaaaaacacggcaaaaattactttgaaaatggatatgatgcccgccatgctgcatttttagaagataactttaaaatattatctcagtataataaagagtattctgttgaaagatcagtcctcattacccagcaacattgggatacgctgataggtgagttagctggtgtcaccagaaatggagacaaaacactcagtggtaaaagttatattgactattatgaagaaggaaaacgtctggagaaaaaaccggatgaattccagaagcaagtctttgacccattgaaaggaaatattgacctttctgacagcaaatcttctacgttattgaaatttgttacgccattattaactcccggtgaggaaattcgtgaaaggaggcagtccggaaaatatgaatatattaccgagttattagtcaagggtgttgataaatggacggtgaagggggttcaggacaagggggctgtatatgattactctaacctgattcagcatgcatcagtcggtaataaccagtatcgggaaatccgtattgagtcacacctgggagacggggatgataaggtctttttatctgccggctcagccaatatctacgcaggtaaaggacatgatgttgtttattatgataaaacagacactggttatctgaccattgatggcacaaaagcaaccgaagcgggtaattacacggtaacacgtgtacttggtggcgatgttaaggttttacaggaagttgtgaaggagcaggaggtttcagtcggaaaaagaactgaaaaaacgcaatatcggagttatgaattcactcatatcaatggtaaaaatttaacagagactgataacttatattccgtggaagaacttattgggaccacgcgtgccgacaagttttttggcagtaaatttactgatatcttccatggcgcggatggtgatgaccttatagaaggaaatgatgggaatgaccgcttatatggtgataaaggtaatgacacactgagtggtggaaacggagatgaccagctctatggcggtgatggtaacgataagttgattgggggagcaggtaataattacctgaacggcggagatggagatgatgagcttcaggttcagggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttgga

SEQ ID NO: 195 - DNA, 513 bp, Escherichia coli; identical to SEQ ID NO: 158

SEQ ID NO: 196 - protein, 170 aa, Escherichia coli
MNINKPLEILGHVSWLWASSPLHRNWPVSLFAINVLPAIQANQYVLLTRDDYPVAYCSWANLSLENEIKYLNDVTSLVAEDWTSGDRKWFIDWIAPFGDNGALYKYMRKKFPDELFRAIRVDPKTHVGKVSEFHGGKIDKQLANKIFKQYHHELITEVKRKSDFNFSLTG

SEQ ID NO: 197 - DNA, 24 bp, Artificial
  Oligonucleotide primer
gaggtaattaaatgggaaattctc

SEQ ID NO: 198 - DNA, 19 bp, Artificial
  Oligonucleotide primer
gctcgaattcgtaatcatg

SEQ ID NO: 199 - DNA, 41 bp, Artificial
  Oligonucleotide primer
attacgaattcgagcatgaatataaacaaaccattagagat

SEQ ID NO: 200 - DNA, 42 bp, Artificial
  Oligonucleotide primer
ccatttaattacctcttaaccagttaatgaaaaattaaaatc

SEQ ID NO: 201 - DNA, 19 bp, Artificial
  Oligonucleotide primer
gctcgaattcgtaatcatg

SEQ ID NO: 202 - DNA, 26 bp, Artificial
  Oligonucleotide primer
gaatataaacaaaccattagagattc

SEQ ID NO: 203 - DNA, 16 bp, Artificial
  Oligonucleotide primer
acacagaaactggcca

SEQ ID NO: 204 - DNA, 22 bp, Artificial
  Oligonucleotide primer
ccaatatgttttattaacccgg

SEQ ID NO: 205 - DNA, 31 bp, Artificial
  Oligonucleotide primer
aagtttagaaaatgaaattaaatatcttaat

SEQ ID NO: 206 - DNA, 20 bp, Artificial
  Oligonucleotide primer
gacttcaggtgatcgtaaat

SEQ ID NO: 207 - DNA, 23 bp, Artificial
  Oligonucleotide primer
cctgtacaaatatatgcgaaaaa

SEQ ID NO: 208 - DNA, 35 bp, Artificial
  Oligonucleotide primer
gaaacagctatgacattattacgaattcgagcatg

SEQ ID NO: 209 - DNA, 35 bp, Artificial
  Oligonucleotide primer
catgctcgaattcgtaataatgtcatagctgtttc

SEQ ID NO: 210 - DNA, 4910 bp, Artificial
  modified pSU expression vector
tgattacgaattcgagcatgaatataaacaaaccattagagattcttgggcatgtatcctggctatgggccagttctccactacacagaaactggccagtatctttgtttgcaataaatgtattacccgcaatacaggctaaccaatatgttttattaacccgggatgattaccctgtcgcgtattgtagttgggctaatttaagtttagaaaatgaaattaaatatcttaatgatgttacctcattagttgcagaagactggacttcaggtgatcgtaaatggttcattgactggattgctcctttcggggataacggtgccctgtacaaatatatgcgaaaaaaattccctgatgaactattcagagccatcagggtggatcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 211 - DNA, 4910 bp, Artificial
  modified pSU expression vector
ttattacgaattcgagcatgaatataaacaaaccattagagattcttgggcatgtatcctggctatgggccagttctccactacacagaaactggccagtatctttgtttgcaataaatgtattacccgcaatacaggctaaccaatatgttttattaacccgggatgattaccctgtcgcgtattgtagttgggctaatttaagtttagaaaatgaaattaaatatcttaatgatgttacctcattagttgcagaagactggacttcaggtgatcgtaaatggttcattgactggattgctcctttcggggataacggtgccctgtacaaatatatgcgaaaaaaattccctgatgaactattcagagccatcagggtggatcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 212 - DNA, 4908 bp, Artificial
  modified pSU expression vector
tgattacgaattcgagcgaatataaacaaaccattagagattcttgggcatgtatcctggctatgggccagttctccactacacagaaactggccagtatctttgtttgcaataaatgtattacccgcaatacaggctaaccaatatgttttattaacccgggatgattaccctgtcgcgtattgtagttgggctaatttaagtttagaaaatgaaattaaatatcttaatgatgttacctcattagttgcagaagactggacttcaggtgatcgtaaatggttcattgactggattgctcctttcggggataacggtgccctgtacaaatatatgcgaaaaaaattccctgatgaactattcagagccatcagggtggatcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 213 - DNA, 4845 bp, Artificial
  modified pSU expression vector
tgattacgaattcgagcacacagaaactggccagtatctttgtttgcaataaatgtattacccgcaatacaggctaaccaatatgttttattaacccgggatgattaccctgtcgcgtattgtagttgggctaatttaagtttagaaaatgaaattaaatatcttaatgatgttacctcattagttgcagaagactggacttcaggtgatcgtaaatggttcattgactggattgctcctttcggggataacggtgccctgtacaaatatatgcgaaaaaaattccctgatgaactattcagagccatcagggtggatcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 214 - DNA, 4785 bp, Artificial
  modified pSU expression vector
tgattacgaattcgagcccaatatgttttattaacccgggatgattaccctgtcgcgtattgtagttgggctaatttaagtttagaaaatgaaattaaatatcttaatgatgttacctcattagttgcagaagactggacttcaggtgatcgtaaatggttcattgactggattgctcctttcggggataacggtgccctgtacaaatatatgcgaaaaaaattccctgatgaactattcagagccatcagggtggatcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 215 - DNA, 4725 bp, Artificial
  modified pSU expression vector
tgattacgaattcgagcaagtttagaaaatgaaattaaatatcttaatgatgttacctcattagttgcagaagactggacttcaggtgatcgtaaatggttcattgactggattgctcctttcggggataacggtgccctgtacaaatatatgcgaaaaaaattccctgatgaactattcagagccatcagggtggatcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 216 - DNA, 4665 bp, Artificial
  modified pSU expression vector
tgattacgaattcgagcgacttcaggtgatcgtaaatggttcattgactggattgctcctttcggggataacggtgccctgtacaaatatatgcgaaaaaaattccctgatgaactattcagagccatcagggtggatcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 217 - DNA, 4605 bp, Artificial
  modified pSU expression vector
tgattacgaattcgagccctgtacaaatatatgcgaaaaaaattccctgatgaactattcagagccatcagggtggatcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataatatattaatttaaatgatagcaatcttactgggctgtgccacataagattgctattttttttggagtcataatggattcttgtcataaaattgattatgggttatacgccctggagattttagcccaataccataacgtctctgttaacccggaagaaattaaacatagatttgatacagacgggacaggtctgggattaacgtcatggttgcttgctgcgaaatctttagaactaaaggtaaaacaggtaaaaaaaacaattgatcgatgataagctgtcaaacatgagaattacaacttatatcgtatggggctgacttcaggtgctacatttgaagagataaattgcactgaaatcctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccgttaacggattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgccgttaacggccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaca

SEQ ID NO: 218 - DNA, 34 bp, Artificial
  Oligonucleotide primer
ctgtattttcagggctgtgatctgccgcagactc

SEQ ID NO: 219 - DNA, 58 bp, Artificial; identical to SEQ ID NO: 61
  Oligonucleotide primer

SEQ ID NO: 220 - DNA, 1365 bp, Artificial
  HlyC/gap/IFNa2/HlyA1 construct
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgcaccaccaccaccaccacgaaaacctgtattttcagggctgtgatctgccgcagactcactctctgggttctcgtcgtactctgatgctgctggctcagatgcgtcgtatctctcttttctcctgcttgaaggaccgtcatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaaattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 221 - DNA, 1206 bp, Artificial
  IFNa2/HlyA1 construct
atgcaccaccaccaccaccacgaaaacctgtattttcagggctgtgatctgccgcagactcactctctgggttctcgtcgtactctgatgctgctggctcagatgcgtcgtatctctcttttctcctgcttgaaggaccgtcatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaaattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 222 - protein, 401 aa, Artificial
  His-IFNa2-TEV-HlyA1 fusion
MHHHHHHENLYFQGCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 223 - DNA, 27 bp, Artificial
  Oligonucleotide primer
ggaaattctcttgcaaaaaatgtatta

SEQ ID NO: 224 - DNA, 67 bp, Artificial
  Oligonucleotide primer
gccctgaaaatacaggttttcgtggtggtggtggtggtgcatttaattacctcttaaccagttaatg

SEQ ID NO: 225 - DNA, 34 bp, Artificial; identical to SEQ ID NO: 59
  Oligonucleotide primer

SEQ ID NO: 226 - DNA, 46 bp, Artificial
  Oligonucleotide primer
gtgacggccatcaatttccttacttcttaaactttcttgcaagttt

SEQ ID NO: 227 - DNA, 1344 bp, Artificial
  Expression construct
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgtgtgatctgccgcagactcactctctgggttctcgtcgtactctgatgctgctggctcagatgcgtcgtatctctcttttctcctgcttgaaggaccgtcatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaaattgatggccgtcaccaccaccaccaccacggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 228 - DNA, 1185 bp, Artificial
  Expression construct
atgtgtgatctgccgcagactcactctctgggttctcgtcgtactctgatgctgctggctcagatgcgtcgtatctctcttttctcctgcttgaaggaccgtcatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaaattgatggccgtcaccaccaccaccaccacggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 229 - protein, 394 aa, Artificial
  IFNa2-HlyA1 fusion protein
MCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEIDGRHHHHHHGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 230 - DNA, 57 bp, Artificial
  Oligonucleotide primer
attgatggccgtcaccaccaccaccaccacggaaattctcttgcaaaaaatgtatta

SEQ ID NO: 231 - DNA, 28 bp, Artificial
  Oligonucleotide primer
catttaattacctcttaaccagttaatg

SEQ ID NO: 232 - DNA, 30 bp, Artificial; identical to SEQ ID NO: 64
  Oligonucleotide primer

SEQ ID NO: 233 - DNA, 43 bp, Artificial
  Oligonucleotide primer
tgcaagagaatttccacggccatcaatgggggtgacgatgccg

SEQ ID NO: 234 - DNA, 1782 bp, Artificial
  Expression construct
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgctaccttccggttcggaccctgccttttcgcagcccaagtcggtgctcgatgcgggtctgacctgccagggtgcttcgccatcctcggtctccaaacccatccttctcgtccccggaaccggcaccacaggtccacagtcgttcgactcgaactggatccccctctctgcgcagctgggttacacaccctgctggatctcacccccgccgttcatgctcaacgacacccaggtcaacacggagtacatggtcaacgccatcaccacgctctacgctggttcgggcaacaacaagcttcccgtgctcacctggtcccagggtggtctggttgcacagtggggtctgaccttcttccccagtatcaggtccaaggtcgatcgacttatggcctttgcgcccgactacaagggcaccgtcctcgccggccctctcgatgcactcgcggttagtgcaccctccgtatggcagcaaaccaccggttcggcactcactaccgcactccgaaacgcaggtggtctgacccagatcgtgcccaccaccaacctctactcggcgaccgacgagatcgttcagcctcaggtgtccaactcgccactcgactcatcctacctcttcaacggaaagaacgtccaggcacaggctgtgtgtgggccgctgttcgtcatcgaccatgcaggctcgctcacctcgcagttctcctacgtcgtcggtcgatccgccctgcgctccaccacgggccaggctcgtagtgcagactatggcattacggactgcaaccctcttcccgccaatgatctgactcccgagcaaaaggtcgccgcggctgcgctcctggcgccggcggctgcagccatcgtggcgggtccaaagcagaactgcgagcccgacctcatgccctacgcccgcccctttgcagtaggcaaaaggacctgctccggcatcgtcacccccattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 235 - DNA, 1623 bp, Artificial
  Expression construct
atgctaccttccggttcggaccctgccttttcgcagcccaagtcggtgctcgatgcgggtctgacctgccagggtgcttcgccatcctcggtctccaaacccatccttctcgtccccggaaccggcaccacaggtccacagtcgttcgactcgaactggatccccctctctgcgcagctgggttacacaccctgctggatctcacccccgccgttcatgctcaacgacacccaggtcaacacggagtacatggtcaacgccatcaccacgctctacgctggttcgggcaacaacaagcttcccgtgctcacctggtcccagggtggtctggttgcacagtggggtctgaccttcttccccagtatcaggtccaaggtcgatcgacttatggcctttgcgcccgactacaagggcaccgtcctcgccggccctctcgatgcactcgcggttagtgcaccctccgtatggcagcaaaccaccggttcggcactcactaccgcactccgaaacgcaggtggtctgacccagatcgtgcccaccaccaacctctactcggcgaccgacgagatcgttcagcctcaggtgtccaactcgccactcgactcatcctacctcttcaacggaaagaacgtccaggcacaggctgtgtgtgggccgctgttcgtcatcgaccatgcaggctcgctcacctcgcagttctcctacgtcgtcggtcgatccgccctgcgctccaccacgggccaggctcgtagtgcagactatggcattacggactgcaaccctcttcccgccaatgatctgactcccgagcaaaaggtcgccgcggctgcgctcctggcgccggcggctgcagccatcgtggcgggtccaaagcagaactgcgagcccgacctcatgccctacgcccgcccctttgcagtaggcaaaaggacctgctccggcatcgtcacccccattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 236 - protein, 540 aa, Artificial
  CalB-HlyA1 fusion
MLPSGSDPAFSQPKSVLDAGLTCQGASPSSVSKPILLVPGTGTTGPQSFDSNWIPLSAQLGYTPCWISPPPFMLNDTQVNTEYMVNAITTLYAGSGNNKLPVLTWSQGGLVAQWGLTFFPSIRSKVDRLMAFAPDYKGTVLAGPLDALAVSAPSVWQQTTGSALTTALRNAGGLTQIVPTTNLYSATDEIVQPQVSNSPLDSSYLFNGKNVQAQAVCGPLFVIDHAGSLTSQFSYVVGRSALRSTTGQARSADYGITDCNPLPANDLTPEQKVAAAALLAPAAAAIVAGPKQNCEPDLMPYARPFAVGKRTCSGIVTPIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 237 - DNA, 41 bp, Artificial; identical to SEQ ID NO: 128
  Oligonucleotide primer

SEQ ID NO: 238 - DNA, 53 bp, Artificial
  Oligonucleotide primer
tgcaagagaatttccacggccatcaattttgcttacgtgaatactacaatgac

SEQ ID NO: 239 - DNA, 999 bp, Artificial
  Expression construct
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgagtacaaaagattttaacttggatttggtatctgtttcgaagaaagattcaggtgcatcaccacgcattacaagtatttcgctatgtacacccggttgtaaaacaggagctctgatgggttgtaacatgaaaacagcaacttgtcattgtagtattcacgtaagcaaaattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 240 - DNA, 840 bp, Artificial
  Expression construct
atgagtacaaaagattttaacttggatttggtatctgtttcgaagaaagattcaggtgcatcaccacgcattacaagtatttcgctatgtacacccggttgtaaaacaggagctctgatgggttgtaacatgaaaacagcaacttgtcattgtagtattcacgtaagcaaaattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 241 - protein, 279 aa, Artificial
  Nisin-HlyA1 fusion
MSTKDFNLDLVSVSKKDSGASPRITSISLCTPGCKTGALMGCNMKTATCHCSIHVSKIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 242 - DNA, 30 bp, Artificial
  Oligonucleotide primer
agaggtaattaaatggccgaaacacccctg

SEQ ID NO: 243 - DNA, 39 bp, Artificial
  Oligonucleotide primer
tgcaagagaatttccacggccatcaatgcgcacgcgctc

SEQ ID NO: 244 - DNA, 2538 bp, Artificial
  Expression construct
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatggccgaaacacccctgcgcctggagcgcctggagcgctgcggcgatctcctggccagcgagcggcaggagtggtgcctgcgcgtgcgcggcctgggcgccggcctgccgcgcctgttgctggacggccgcgaactgccggccaccgccctgcggcgcgagggcgacggcctgcggctccgcctggaccgccgtggccacgccagcggtccgctttggctggagcagggcgggcgcagcagcaatccggtatggctgaccctgaacggcagtcatgtgctcgccgccggtcccgacgaggtggcgaagaacatggatggcctgaccacctacgtcgacctggtcagcctgttgatcgaggagaaccacgacggtcgccgggaggccgaacgcctggccgataaatatggcgcgcgggtggtcggcgcgatcccgccgttgaacctctaccagttgcgcctgccggcgcgcgacctcgtccagcgcgacgcgctggtcctccgcatcggcagcgagaccagcgtggacgccgtggtggtggaggagtccgcgccggagaagggcgaggaaaccgaggcggcgcgccggcccgtggacaagccggacagcgactccgacgagtgggcggccaatcgtttcatggacgcggtgaactattaccagcgtcgggtccgcgcccgccaggcgccgctggagacccgcccggtgcgcatcggggtgatcgagcgcgacgtcgacttcgacgctcccgacttcgccgactacctcggcccctgcaaggcgcccgcaccgcgtacctgcctctacgcgcgcgatgccgaacgtcccgacaaccacggttcgacggtcgccggcatcctcgccgcgcgctgggaccagggcggcaacagtggcttcctgcgtgggctggaccgcgccagccagggtttcgaagtgatcgtcgagcgcaattcggatgctggcatcacggccaacgtcgccgcctcggtgaacctggtggaggatggcgtgcgggtgctcaactggagctggggcatccaccgcgtcggcgctcgcgacgtcgatggcgacgaggtggattcgctggtgcgctcggggattgccatgagcggctacgaggagttgctcgaggagttcttcctctggctgcgcaaggagcatccggacgtgctggtggtcaactccgccggcaacggctcgtcctactccggtaccgacgaataccgcctgccgtcctccttcgtcaccgagcagttgctggtggtgggcggccaccagcgcagcgagcgccaaggcctggcggtggacgacccggcctacgcggtcaagcgcagcacctcgaacgtcgacatgcgggtggatgtcaccgccgccgcctgtacccatgcctcgaccctggagcgggacgcgcggggcgaggtgcactgcggcacctcctatgccacgccgatggtcgccggcacggtcgccgccatgctttccctcaacccgcggctgcgacccgaggagatccgcatgctgctccggcgcagcgccatgaccatcggcggcgactacgatttcgagccggccgatgccgaggacctcaccgcaccgatcctgccctcggagcgcggctaccgcctggaccaccgcgacgtcggccgctcggcgcggctggacatgcagaaagccctggacctggcggtgaagagccgcgagcgcgtgcgcattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 245 - DNA, 2379 bp, Artificial
  Expression construct
atggccgaaacacccctgcgcctggagcgcctggagcgctgcggcgatctcctggccagcgagcggcaggagtggtgcctgcgcgtgcgcggcctgggcgccggcctgccgcgcctgttgctggacggccgcgaactgccggccaccgccctgcggcgcgagggcgacggcctgcggctccgcctggaccgccgtggccacgccagcggtccgctttggctggagcagggcgggcgcagcagcaatccggtatggctgaccctgaacggcagtcatgtgctcgccgccggtcccgacgaggtggcgaagaacatggatggcctgaccacctacgtcgacctggtcagcctgttgatcgaggagaaccacgacggtcgccgggaggccgaacgcctggccgataaatatggcgcgcgggtggtcggcgcgatcccgccgttgaacctctaccagttgcgcctgccggcgcgcgacctcgtccagcgcgacgcgctggtcctccgcatcggcagcgagaccagcgtggacgccgtggtggtggaggagtccgcgccggagaagggcgaggaaaccgaggcggcgcgccggcccgtggacaagccggacagcgactccgacgagtgggcggccaatcgtttcatggacgcggtgaactattaccagcgtcgggtccgcgcccgccaggcgccgctggagacccgcccggtgcgcatcggggtgatcgagcgcgacgtcgacttcgacgctcccgacttcgccgactacctcggcccctgcaaggcgcccgcaccgcgtacctgcctctacgcgcgcgatgccgaacgtcccgacaaccacggttcgacggtcgccggcatcctcgccgcgcgctgggaccagggcggcaacagtggcttcctgcgtgggctggaccgcgccagccagggtttcgaagtgatcgtcgagcgcaattcggatgctggcatcacggccaacgtcgccgcctcggtgaacctggtggaggatggcgtgcgggtgctcaactggagctggggcatccaccgcgtcggcgctcgcgacgtcgatggcgacgaggtggattcgctggtgcgctcggggattgccatgagcggctacgaggagttgctcgaggagttcttcctctggctgcgcaaggagcatccggacgtgctggtggtcaactccgccggcaacggctcgtcctactccggtaccgacgaataccgcctgccgtcctccttcgtcaccgagcagttgctggtggtgggcggccaccagcgcagcgagcgccaaggcctggcggtggacgacccggcctacgcggtcaagcgcagcacctcgaacgtcgacatgcgggtggatgtcaccgccgccgcctgtacccatgcctcgaccctggagcgggacgcgcggggcgaggtgcactgcggcacctcctatgccacgccgatggtcgccggcacggtcgccgccatgctttccctcaacccgcggctgcgacccgaggagatccgcatgctgctccggcgcagcgccatgaccatcggcggcgactacgatttcgagccggccgatgccgaggacctcaccgcaccgatcctgccctcggagcgcggctaccgcctggaccaccgcgacgtcggccgctcggcgcggctggacatgcagaaagccctggacctggcggtgaagagccgcgagcgcgtgcgcattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 246 - protein, 792 aa, Artificial
  SprP-HlyA1 fusion
MAETPLRLERLERCGDLLASERQEWCLRVRGLGAGLPRLLLDGRELPATALRREGDGLRLRLDRRGHASGPLWLEQGGRSSNPVWLTLNGSHVLAAGPDEVAKNMDGLTTYVDLVSLLIEENHDGRREAERLADKYGARVVGAIPPLNLYQLRLPARDLVQRDALVLRIGSETSVDAVVVEESAPEKGEETEAARRPVDKPDSDSDEWAANRFMDAVNYYQRRVRARQAPLETRPVRIGVIERDVDFDAPDFADYLGPCKAPAPRTCLYARDAERPDNHGSTVAGILAARWDQGGNSGFLRGLDRASQGFEVIVERNSDAGITANVAASVNLVEDGVRVLNWSWGIHRVGARDVDGDEVDSLVRSGIAMSGYEELLEEFFLWLRKEHPDVLVVNSAGNGSSYSGTDEYRLPSSFVTEQLLVVGGHQRSERQGLAVDDPAYAVKRSTSNVDMRVDVTAAACTHASTLERDARGEVHCGTSYATPMVAGTVAAMLSLNPRLRPEEIRMLLRRSAMTIGGDYDFEPADAEDLTAPILPSERGYRLDHRDVGRSARLDMQKALDLAVKSRERVRIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 247 - DNA, 29 bp, Artificial
  Oligonucleotide primer
ctgtattttcagggcgccgaaacacccct

SEQ ID NO: 248 - DNA, 39 bp, Artificial; identical to SEQ ID NO: 243
  Oligonucleotide primer

SEQ ID NO: 249 - DNA, 2574 bp, Artificial
  Expression construct
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgcaccaccaccaccaccacgaaaacctgtattttcaggccgaaacacccctgcgcctggagcgcctggagcgctgcggcgatctcctggccagcgagcggcaggagtggtgcctgcgcgtgcgcggcctgggcgccggcctgccgcgcctgttgctggacggccgcgaactgccggccaccgccctgcggcgcgagggcgacggcctgcggctccgcctggaccgccgtggccacgccagcggtccgctttggctggagcagggcgggcgcagcagcaatccggtatggctgaccctgaacggcagtcatgtgctcgccgccggtcccgacgaggtggcgaagaacatggatggcctgaccacctacgtcgacctggtcagcctgttgatcgaggagaaccacgacggtcgccgggaggccgaacgcctggccgataaatatggcgcgcgggtggtcggcgcgatcccgccgttgaacctctaccagttgcgcctgccggcgcgcgacctcgtccagcgcgacgcgctggtcctccgcatcggcagcgagaccagcgtggacgccgtggtggtggaggagtccgcgccggagaagggcgaggaaaccgaggcggcgcgccggcccgtggacaagccggacagcgactccgacgagtgggcggccaatcgtttcatggacgcggtgaactattaccagcgtcgggtccgcgcccgccaggcgccgctggagacccgcccggtgcgcatcggggtgatcgagcgcgacgtcgacttcgacgctcccgacttcgccgactacctcggcccctgcaaggcgcccgcaccgcgtacctgcctctacgcgcgcgatgccgaacgtcccgacaaccacggttcgacggtcgccggcatcctcgccgcgcgctgggaccagggcggcaacagtggcttcctgcgtgggctggaccgcgccagccagggtttcgaagtgatcgtcgagcgcaattcggatgctggcatcacggccaacgtcgccgcctcggtgaacctggtggaggatggcgtgcgggtgctcaactggagctggggcatccaccgcgtcggcgctcgcgacgtcgatggcgacgaggtggattcgctggtgcgctcggggattgccatgagcggctacgaggagttgctcgaggagttcttcctctggctgcgcaaggagcatccggacgtgctggtggtcaactccgccggcaacggctcgtcctactccggtaccgacgaataccgcctgccgtcctccttcgtcaccgagcagttgctggtggtgggcggccaccagcgcagcgagcgccaaggcctggcggtggacgacccggcctacgcggtcaagcgcagcacctcgaacgtcgacatgcgggtggatgtcaccgccgccgcctgtacccatgcctcgaccctggagcgggacgcgcggggcgaggtgcactgcggcacctcctatgccacgccgatggtcgccggcacggtcgccgccatgctttccctcaacccgcggctgcgacccgaggagatccgcatgctgctccggcgcagcgccatgaccatcggcggcgactacgatttcgagccggccgatgccgaggacctcaccgcaccgatcctgccctcggagcgcggctaccgcctggaccaccgcgacgtcggccgctcggcgcggctggacatgcagaaagccctggacctggcggtgaagagccgcgagcgcgtgcgcattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 250 - DNA, 2415 bp, Artificial
  Expression construct
atgcaccaccaccaccaccacgaaaacctgtattttcaggccgaaacacccctgcgcctggagcgcctggagcgctgcggcgatctcctggccagcgagcggcaggagtggtgcctgcgcgtgcgcggcctgggcgccggcctgccgcgcctgttgctggacggccgcgaactgccggccaccgccctgcggcgcgagggcgacggcctgcggctccgcctggaccgccgtggccacgccagcggtccgctttggctggagcagggcgggcgcagcagcaatccggtatggctgaccctgaacggcagtcatgtgctcgccgccggtcccgacgaggtggcgaagaacatggatggcctgaccacctacgtcgacctggtcagcctgttgatcgaggagaaccacgacggtcgccgggaggccgaacgcctggccgataaatatggcgcgcgggtggtcggcgcgatcccgccgttgaacctctaccagttgcgcctgccggcgcgcgacctcgtccagcgcgacgcgctggtcctccgcatcggcagcgagaccagcgtggacgccgtggtggtggaggagtccgcgccggagaagggcgaggaaaccgaggcggcgcgccggcccgtggacaagccggacagcgactccgacgagtgggcggccaatcgtttcatggacgcggtgaactattaccagcgtcgggtccgcgcccgccaggcgccgctggagacccgcccggtgcgcatcggggtgatcgagcgcgacgtcgacttcgacgctcccgacttcgccgactacctcggcccctgcaaggcgcccgcaccgcgtacctgcctctacgcgcgcgatgccgaacgtcccgacaaccacggttcgacggtcgccggcatcctcgccgcgcgctgggaccagggcggcaacagtggcttcctgcgtgggctggaccgcgccagccagggtttcgaagtgatcgtcgagcgcaattcggatgctggcatcacggccaacgtcgccgcctcggtgaacctggtggaggatggcgtgcgggtgctcaactggagctggggcatccaccgcgtcggcgctcgcgacgtcgatggcgacgaggtggattcgctggtgcgctcggggattgccatgagcggctacgaggagttgctcgaggagttcttcctctggctgcgcaaggagcatccggacgtgctggtggtcaactccgccggcaacggctcgtcctactccggtaccgacgaataccgcctgccgtcctccttcgtcaccgagcagttgctggtggtgggcggccaccagcgcagcgagcgccaaggcctggcggtggacgacccggcctacgcggtcaagcgcagcacctcgaacgtcgacatgcgggtggatgtcaccgccgccgcctgtacccatgcctcgaccctggagcgggacgcgcggggcgaggtgcactgcggcacctcctatgccacgccgatggtcgccggcacggtcgccgccatgctttccctcaacccgcggctgcgacccgaggagatccgcatgctgctccggcgcagcgccatgaccatcggcggcgactacgatttcgagccggccgatgccgaggacctcaccgcaccgatcctgccctcggagcgcggctaccgcctggaccaccgcgacgtcggccgctcggcgcggctggacatgcagaaagccctggacctggcggtgaagagccgcgagcgcgtgcgcattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 251 - protein, 805 aa, Artificial
  SprP-HlyA1 fusion
MHHHHHHENLYFQGAETPLRLERLERCGDLLASERQEWCLRVRGLGAGLPRLLLDGRELPATALRREGDGLRLRLDRRGHASGPLWLEQGGRSSNPVWLTLNGSHVLAAGPDEVAKNMDGLTTYVDLVSLLIEENHDGRREAERLADKYGARVVGAIPPLNLYQLRLPARDLVQRDALVLRIGSETSVDAVVVEESAPEKGEETEAARRPVDKPDSDSDEWAANRFMDAVNYYQRRVRARQAPLETRPVRIGVIERDVDFDAPDFADYLGPCKAPAPRTCLYARDAERPDNHGSTVAGILAARWDQGGNSGFLRGLDRASQGFEVIVERNSDAGITANVAASVNLVEDGVRVLNWSWGIHRVGARDVDGDEVDSLVRSGIAMSGYEELLEEFFLWLRKEHPDVLVVNSAGNGSSYSGTDEYRLPSSFVTEQLLVVGGHQRSERQGLAVDDPAYAVKRSTSNVDMRVDVTAAACTHASTLERDARGEVHCGTSYATPMVAGTVAAMLSLNPRLRPEEIRMLLRRSAMTIGGDYDFEPADAEDLTAPILPSERGYRLDHRDVGRSARLDMQKALDLAVKSRERVRIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 252 - DNA, 30 bp, Artificial; identical to SEQ ID NO: 242
  Oligonucleotide primer

SEQ ID NO: 253 - DNA, 27 bp, Artificial
  Oligonucleotide primer
gtgacggccatcaatgcgcacgcgctc

SEQ ID NO: 254 - DNA, 2556 bp, Artificial
  Expression construct
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatggccgaaacacccctgcgcctggagcgcctggagcgctgcggcgatctcctggccagcgagcggcaggagtggtgcctgcgcgtgcgcggcctgggcgccggcctgccgcgcctgttgctggacggccgcgaactgccggccaccgccctgcggcgcgagggcgacggcctgcggctccgcctggaccgccgtggccacgccagcggtccgctttggctggagcagggcgggcgcagcagcaatccggtatggctgaccctgaacggcagtcatgtgctcgccgccggtcccgacgaggtggcgaagaacatggatggcctgaccacctacgtcgacctggtcagcctgttgatcgaggagaaccacgacggtcgccgggaggccgaacgcctggccgataaatatggcgcgcgggtggtcggcgcgatcccgccgttgaacctctaccagttgcgcctgccggcgcgcgacctcgtccagcgcgacgcgctggtcctccgcatcggcagcgagaccagcgtggacgccgtggtggtggaggagtccgcgccggagaagggcgaggaaaccgaggcggcgcgccggcccgtggacaagccggacagcgactccgacgagtgggcggccaatcgtttcatggacgcggtgaactattaccagcgtcgggtccgcgcccgccaggcgccgctggagacccgcccggtgcgcatcggggtgatcgagcgcgacgtcgacttcgacgctcccgacttcgccgactacctcggcccctgcaaggcgcccgcaccgcgtacctgcctctacgcgcgcgatgccgaacgtcccgacaaccacggttcgacggtcgccggcatcctcgccgcgcgctgggaccagggcggcaacagtggcttcctgcgtgggctggaccgcgccagccagggtttcgaagtgatcgtcgagcgcaattcggatgctggcatcacggccaacgtcgccgcctcggtgaacctggtggaggatggcgtgcgggtgctcaactggagctggggcatccaccgcgtcggcgctcgcgacgtcgatggcgacgaggtggattcgctggtgcgctcggggattgccatgagcggctacgaggagttgctcgaggagttcttcctctggctgcgcaaggagcatccggacgtgctggtggtcaactccgccggcaacggctcgtcctactccggtaccgacgaataccgcctgccgtcctccttcgtcaccgagcagttgctggtggtgggcggccaccagcgcagcgagcgccaaggcctggcggtggacgacccggcctacgcggtcaagcgcagcacctcgaacgtcgacatgcgggtggatgtcaccgccgccgcctgtacccatgcctcgaccctggagcgggacgcgcggggcgaggtgcactgcggcacctcctatgccacgccgatggtcgccggcacggtcgccgccatgctttccctcaacccgcggctgcgacccgaggagatccgcatgctgctccggcgcagcgccatgaccatcggcggcgactacgatttcgagccggccgatgccgaggacctcaccgcaccgatcctgccctcggagcgcggctaccgcctggaccaccgcgacgtcggccgctcggcgcggctggacatgcagaaagccctggacctggcggtgaagagccgcgagcgcgtgcgcattgatggccgtcaccaccaccaccaccacggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 255 - DNA, 2397 bp, Artificial
  Expression construct
atggccgaaacacccctgcgcctggagcgcctggagcgctgcggcgatctcctggccagcgagcggcaggagtggtgcctgcgcgtgcgcggcctgggcgccggcctgccgcgcctgttgctggacggccgcgaactgccggccaccgccctgcggcgcgagggcgacggcctgcggctccgcctggaccgccgtggccacgccagcggtccgctttggctggagcagggcgggcgcagcagcaatccggtatggctgaccctgaacggcagtcatgtgctcgccgccggtcccgacgaggtggcgaagaacatggatggcctgaccacctacgtcgacctggtcagcctgttgatcgaggagaaccacgacggtcgccgggaggccgaacgcctggccgataaatatggcgcgcgggtggtcggcgcgatcccgccgttgaacctctaccagttgcgcctgccggcgcgcgacctcgtccagcgcgacgcgctggtcctccgcatcggcagcgagaccagcgtggacgccgtggtggtggaggagtccgcgccggagaagggcgaggaaaccgaggcggcgcgccggcccgtggacaagccggacagcgactccgacgagtgggcggccaatcgtttcatggacgcggtgaactattaccagcgtcgggtccgcgcccgccaggcgccgctggagacccgcccggtgcgcatcggggtgatcgagcgcgacgtcgacttcgacgctcccgacttcgccgactacctcggcccctgcaaggcgcccgcaccgcgtacctgcctctacgcgcgcgatgccgaacgtcccgacaaccacggttcgacggtcgccggcatcctcgccgcgcgctgggaccagggcggcaacagtggcttcctgcgtgggctggaccgcgccagccagggtttcgaagtgatcgtcgagcgcaattcggatgctggcatcacggccaacgtcgccgcctcggtgaacctggtggaggatggcgtgcgggtgctcaactggagctggggcatccaccgcgtcggcgctcgcgacgtcgatggcgacgaggtggattcgctggtgcgctcggggattgccatgagcggctacgaggagttgctcgaggagttcttcctctggctgcgcaaggagcatccggacgtgctggtggtcaactccgccggcaacggctcgtcctactccggtaccgacgaataccgcctgccgtcctccttcgtcaccgagcagttgctggtggtgggcggccaccagcgcagcgagcgccaaggcctggcggtggacgacccggcctacgcggtcaagcgcagcacctcgaacgtcgacatgcgggtggatgtcaccgccgccgcctgtacccatgcctcgaccctggagcgggacgcgcggggcgaggtgcactgcggcacctcctatgccacgccgatggtcgccggcacggtcgccgccatgctttccctcaacccgcggctgcgacccgaggagatccgcatgctgctccggcgcagcgccatgaccatcggcggcgactacgatttcgagccggccgatgccgaggacctcaccgcaccgatcctgccctcggagcgcggctaccgcctggaccaccgcgacgtcggccgctcggcgcggctggacatgcagaaagccctggacctggcggtgaagagccgcgagcgcgtgcgcattgatggccgtcaccaccaccaccaccacggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 256 - protein, 798 aa, Artificial
  SprP-HlyA1 fusion
MAETPLRLERLERCGDLLASERQEWCLRVRGLGAGLPRLLLDGRELPATALRREGDGLRLRLDRRGHASGPLWLEQGGRSSNPVWLTLNGSHVLAAGPDEVAKNMDGLTTYVDLVSLLIEENHDGRREAERLADKYGARVVGAIPPLNLYQLRLPARDLVQRDALVLRIGSETSVDAVVVEESAPEKGEETEAARRPVDKPDSDSDEWAANRFMDAVNYYQRRVRARQAPLETRPVRIGVIERDVDFDAPDFADYLGPCKAPAPRTCLYARDAERPDNHGSTVAGILAARWDQGGNSGFLRGLDRASQGFEVIVERNSDAGITANVAASVNLVEDGVRVLNWSWGIHRVGARDVDGDEVDSLVRSGIAMSGYEELLEEFFLWLRKEHPDVLVVNSAGNGSSYSGTDEYRLPSSFVTEQLLVVGGHQRSERQGLAVDDPAYAVKRSTSNVDMRVDVTAAACTHASTLERDARGEVHCGTSYATPMVAGTVAAMLSLNPRLRPEEIRMLLRRSAMTIGGDYDFEPADAEDLTAPILPSERGYRLDHRDVGRSARLDMQKALDLAVKSRERVRIDGRHHHHHHGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 257 - DNA, 29 bp, Artificial
  Oligonucleotide primer
agaggtaattaaatggatggcctgaccac

SEQ ID NO: 258 - DNA, 39 bp, Artificial; identical to SEQ ID NO: 243
  Oligonucleotide primer

SEQ ID NO: 259 - DNA, 2226 bp, Artificial
  Expression construct
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatggatggcctgaccacctacgtcgacctggtcagcctgttgatcgaggagaaccacgacggtcgccgggaggccgaacgcctggccgataaatatggcgcgcgggtggtcggcgcgatcccgccgttgaacctctaccagttgcgcctgccggcgcgcgacctcgtccagcgcgacgcgctggtcctccgcatcggcagcgagaccagcgtggacgccgtggtggtggaggagtccgcgccggagaagggcgaggaaaccgaggcggcgcgccggcccgtggacaagccggacagcgactccgacgagtgggcggccaatcgtttcatggacgcggtgaactattaccagcgtcgggtccgcgcccgccaggcgccgctggagacccgcccggtgcgcatcggggtgatcgagcgcgacgtcgacttcgacgctcccgacttcgccgactacctcggcccctgcaaggcgcccgcaccgcgtacctgcctctacgcgcgcgatgccgaacgtcccgacaaccacggttcgacggtcgccggcatcctcgccgcgcgctgggaccagggcggcaacagtggcttcctgcgtgggctggaccgcgccagccagggtttcgaagtgatcgtcgagcgcaattcggatgctggcatcacggccaacgtcgccgcctcggtgaacctggtggaggatggcgtgcgggtgctcaactggagctggggcatccaccgcgtcggcgctcgcgacgtcgatggcgacgaggtggattcgctggtgcgctcggggattgccatgagcggctacgaggagttgctcgaggagttcttcctctggctgcgcaaggagcatccggacgtgctggtggtcaactccgccggcaacggctcgtcctactccggtaccgacgaataccgcctgccgtcctccttcgtcaccgagcagttgctggtggtgggcggccaccagcgcagcgagcgccaaggcctggcggtggacgacccggcctacgcggtcaagcgcagcacctcgaacgtcgacatgcgggtggatgtcaccgccgccgcctgtacccatgcctcgaccctggagcgggacgcgcggggcgaggtgcactgcggcacctcctatgccacgccgatggtcgccggcacggtcgccgccatgctttccctcaacccgcggctgcgacccgaggagatccgcatgctgctccggcgcagcgccatgaccatcggcggcgactacgatttcgagccggccgatgccgaggacctcaccgcaccgatcctgccctcggagcgcggctaccgcctggaccaccgcgacgtcggccgctcggcgcggctggacatgcagaaagccctggacctggcggtgaagagccgcgagcgcgtgcgcattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 260 - DNA, 2226 bp, Artificial; identical to SEQ ID NO: 259
  Expression construct

SEQ ID NO: 261 - protein, 688 aa, Artificial
  SprP-HlyA1 fusion
MDGLTTYVDLVSLLIEENHDGRREAERLADKYGARVVGAIPPLNLYQLRLPARDLVQRDALVLRIGSETSVDAVVVEESAPEKGEETEAARRPVDKPDSDSDEWAANRFMDAVNYYQRRVRARQAPLETRPVRIGVIERDVDFDAPDFADYLGPCKAPAPRTCLYARDAERPDNHGSTVAGILAARWDQGGNSGFLRGLDRASQGFEVIVERNSDAGITANVAASVNLVEDGVRVLNWSWGIHRVGARDVDGDEVDSLVRSGIAMSGYEELLEEFFLWLRKEHPDVLVVNSAGNGSSYSGTDEYRLPSSFVTEQLLVVGGHQRSERQGLAVDDPAYAVKRSTSNVDMRVDVTAAACTHASTLERDARGEVHCGTSYATPMVAGTVAAMLSLNPRLRPEEIRMLLRRSAMTIGGDYDFEPADAEDLTAPILPSERGYRLDHRDVGRSARLDMQKALDLAVKSRERVRIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 262 - DNA, 27 bp, Artificial
  Oligonucleotide primer
agaggtaattaaatggtgcgcatcggg

SEQ ID NO: 263 - DNA, 39 bp, Artificial; identical to SEQ ID NO: 243
  Oligonucleotide primer

SEQ ID NO: 264 - DNA, 1836 bp, Artificial
  Expression construct
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatggtgcgcatcggggtgatcgagcgcgacgtcgacttcgacgctcccgacttcgccgactacctcggcccctgcaaggcgcccgcaccgcgtacctgcctctacgcgcgcgatgccgaacgtcccgacaaccacggttcgacggtcgccggcatcctcgccgcgcgctgggaccagggcggcaacagtggcttcctgcgtgggctggaccgcgccagccagggtttcgaagtgatcgtcgagcgcaattcggatgctggcatcacggccaacgtcgccgcctcggtgaacctggtggaggatggcgtgcgggtgctcaactggagctggggcatccaccgcgtcggcgctcgcgacgtcgatggcgacgaggtggattcgctggtgcgctcggggattgccatgagcggctacgaggagttgctcgaggagttcttcctctggctgcgcaaggagcatccggacgtgctggtggtcaactccgccggcaacggctcgtcctactccggtaccgacgaataccgcctgccgtcctccttcgtcaccgagcagttgctggtggtgggcggccaccagcgcagcgagcgccaaggcctggcggtggacgacccggcctacgcggtcaagcgcagcacctcgaacgtcgacatgcgggtggatgtcaccgccgccgcctgtacccatgcctcgaccctggagcgggacgcgcggggcgaggtgcactgcggcacctcctatgccacgccgatggtcgccggcacggtcgccgccatgctttccctcaacccgcggctgcgacccgaggagatccgcatgctgctccggcgcagcgccatgaccatcggcggcgactacgatttcgagccggccgatgccgaggacctcaccgcaccgatcctgccctcggagcgcggctaccgcctggaccaccgcgacgtcggccgctcggcgcggctggacatgcagaaagccctggacctggcggtgaagagccgcgagcgcgtgcgcattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 265 - DNA, 1677 bp, Artificial
  Expression construct
atggtgcgcatcggggtgatcgagcgcgacgtcgacttcgacgctcccgacttcgccgactacctcggcccctgcaaggcgcccgcaccgcgtacctgcctctacgcgcgcgatgccgaacgtcccgacaaccacggttcgacggtcgccggcatcctcgccgcgcgctgggaccagggcggcaacagtggcttcctgcgtgggctggaccgcgccagccagggtttcgaagtgatcgtcgagcgcaattcggatgctggcatcacggccaacgtcgccgcctcggtgaacctggtggaggatggcgtgcgggtgctcaactggagctggggcatccaccgcgtcggcgctcgcgacgtcgatggcgacgaggtggattcgctggtgcgctcggggattgccatgagcggctacgaggagttgctcgaggagttcttcctctggctgcgcaaggagcatccggacgtgctggtggtcaactccgccggcaacggctcgtcctactccggtaccgacgaataccgcctgccgtcctccttcgtcaccgagcagttgctggtggtgggcggccaccagcgcagcgagcgccaaggcctggcggtggacgacccggcctacgcggtcaagcgcagcacctcgaacgtcgacatgcgggtggatgtcaccgccgccgcctgtacccatgcctcgaccctggagcgggacgcgcggggcgaggtgcactgcggcacctcctatgccacgccgatggtcgccggcacggtcgccgccatgctttccctcaacccgcggctgcgacccgaggagatccgcatgctgctccggcgcagcgccatgaccatcggcggcgactacgatttcgagccggccgatgccgaggacctcaccgcaccgatcctgccctcggagcgcggctaccgcctggaccaccgcgacgtcggccgctcggcgcggctggacatgcagaaagccctggacctggcggtgaagagccgcgagcgcgtgcgcattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 266 - protein, 558 aa, Artificial
  SprP-HlyA1 fusion
MVRIGVIERDVDFDAPDFADYLGPCKAPAPRTCLYARDAERPDNHGSTVAGILAARWDQGGNSGFLRGLDRASQGFEVIVERNSDAGITANVAASVNLVEDGVRVLNWSWGIHRVGARDVDGDEVDSLVRSGIAMSGYEELLEEFFLWLRKEHPDVLVVNSAGNGSSYSGTDEYRLPSSFVTEQLLVVGGHQRSERQGLAVDDPAYAVKRSTSNVDMRVDVTAAACTHASTLERDARGEVHCGTSYATPMVAGTVAAMLSLNPRLRPEEIRMLLRRSAMTIGGDYDFEPADAEDLTAPILPSERGYRLDHRDVGRSARLDMQKALDLAVKSRERVRIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 267 - DNA, 29 bp, Artificial
  Oligonucleotide primer
agaggtaattaaatgccccgttcgatcgt

SEQ ID NO: 268 - DNA, 48 bp, Artificial
  Oligonucleotide primer
tgcaagagaatttccacggccatcaatggggttcctgaagacgaatac

SEQ ID NO: 269 - DNA, 2157 bp, Artificial
  Expression construct
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgccccgttcgatcgtcatcgtccacggctggagcgacgattcgaagtcgttccgccgcctcgccgagcagttggaagcctggttcggcagcgcgccgacgcagatccgcctcaccgactggatctccctgcaggacgacgtcacctacgccgacctcgccgccgccctggatcgcgcctggaccgcccagggactgtcgcgggcaccgcgcacggttgacgtggtggtgcacagcaccggcaccctggtgctgcgcgactggctgacccgccacttcgaccccgccagcgcgccggtcaagcgcttcctgatgctcgccccggccaacttcggctcgccgctggcgcacaagggacgctccttcatcggtcgcgtgctgaaaggctggaaccgcttcgtcgggcagaccggcacccaggtgctgaagggactggagctgggctcgccgtactcctggcaactcgccgagcgcgacctgttcggcgccgaggcctggtacggcgccgaccgcctgctcgccacggtgctggtgggcaatgtcggctacagcggcgtcgaagccatcgccaacgaggccggcagcgacggcactgtgcggatcgccacggcgaacctcaacgcctgccgcctgagcctcgaactggatgtccgccagcgcgccaggcccggctggcgcctggaagaatcgcgcggcgagatcgccttcgccatcgtcgacggcgagaaccacgccagcgtggcgctgaaggaccgcggaccgaagaacccgcataccctggagctgatccgcgccgcactggaggtcgaggacgccgattaccggagcagcggcgcaagcttcccctggcagcgccgcatcgatcagctcgaccccggcatcgagcgccgctcgccgcgctacctgaacctggtcagccacgtctgcgacgacctcgaccaggaggtgcgcgactacttcatccagttcttccgcaagctgaacagcgaccggcgtttcgagcagcgcttctacgagcaggtcatcgccgacgtccatccctacgaggacaaccccgcctaccgctcgctgtacctgtcgatcgagtccctcgacgacctgctcgccggcttcgccgtggacaccctgtcgctcagcgtgtcggcccagccgccgttcgatccgccgcgccagccggtcggctataccgcggtgggccccggcgacagcgaaggcctggcaattccgctggcgcaggtgccgcgcttcctcgcagcccaccgcaccctgctgctgcgcatccgcctgacgcgcctggtggacagcggcgtattcgtcttcaggaaccccattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 270 - DNA, 1998 bp, Artificial
  Expression construct
atgccccgttcgatcgtcatcgtccacggctggagcgacgattcgaagtcgttccgccgcctcgccgagcagttggaagcctggttcggcagcgcgccgacgcagatccgcctcaccgactggatctccctgcaggacgacgtcacctacgccgacctcgccgccgccctggatcgcgcctggaccgcccagggactgtcgcgggcaccgcgcacggttgacgtggtggtgcacagcaccggcaccctggtgctgcgcgactggctgacccgccacttcgaccccgccagcgcgccggtcaagcgcttcctgatgctcgccccggccaacttcggctcgccgctggcgcacaagggacgctccttcatcggtcgcgtgctgaaaggctggaaccgcttcgtcgggcagaccggcacccaggtgctgaagggactggagctgggctcgccgtactcctggcaactcgccgagcgcgacctgttcggcgccgaggcctggtacggcgccgaccgcctgctcgccacggtgctggtgggcaatgtcggctacagcggcgtcgaagccatcgccaacgaggccggcagcgacggcactgtgcggatcgccacggcgaacctcaacgcctgccgcctgagcctcgaactggatgtccgccagcgcgccaggcccggctggcgcctggaagaatcgcgcggcgagatcgccttcgccatcgtcgacggcgagaaccacgccagcgtggcgctgaaggaccgcggaccgaagaacccgcataccctggagctgatccgcgccgcactggaggtcgaggacgccgattaccggagcagcggcgcaagcttcccctggcagcgccgcatcgatcagctcgaccccggcatcgagcgccgctcgccgcgctacctgaacctggtcagccacgtctgcgacgacctcgaccaggaggtgcgcgactacttcatccagttcttccgcaagctgaacagcgaccggcgtttcgagcagcgcttctacgagcaggtcatcgccgacgtccatccctacgaggacaaccccgcctaccgctcgctgtacctgtcgatcgagtccctcgacgacctgctcgccggcttcgccgtggacaccctgtcgctcagcgtgtcggcccagccgccgttcgatccgccgcgccagccggtcggctataccgcggtgggccccggcgacagcgaaggcctggcaattccgctggcgcaggtgccgcgcttcctcgcagcccaccgcaccctgctgctgcgcatccgcctgacgcgcctggtggacagcggcgtattcgtcttcaggaaccccattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 271 - protein, 665 aa, Artificial
  PlaB-HlyA1 fusion
MPRSIVIVHGWSDDSKSFRRLAEQLEAWFGSAPTQIRLTDWISLQDDVTYADLAAALDRAWTAQGLSRAPRTVDVVVHSTGTLVLRDWLTRHFDPASAPVKRFLMLAPANFGSPLAHKGRSFIGRVLKGWNRFVGQTGTQVLKGLELGSPYSWQLAERDLFGAEAWYGADRLLATVLVGNVGYSGVEAIANEAGSDGTVRIATANLNACRLSLELDVRQRARPGWRLEESRGEIAFAIVDGENHASVALKDRGPKNPHTLELIRAALEVEDADYRSSGASFPWQRRIDQLDPGIERRSPRYLNLVSHVCDDLDQEVRDYFIQFFRKLNSDRRFEQRFYEQVIADVHPYEDNPAYRSLYLSIESLDDLLAGFAVDTLSLSVSAQPPFDPPRQPVGYTAVGPGDSEGLAIPLAQVPRFLAAHRTLLLRIRLTRLVDSGVFVFRNPIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 272 - DNA, 30 bp, Artificial
  Oligonucleotide primer
agaggtaattaaatgccccgaccactttcc

SEQ ID NO: 273 - DNA, 43 bp, Artificial
  Oligonucleotide primer
tgcaagagaatttccacggccatcaatcagacactcccccgcg

SEQ ID NO: 274 - DNA, 2004 bp, Artificial
  Expression construct
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgccccgaccactttcccaccggaacttgcccatgacgccccaaggccactgtgacagccgtttcgccccgcttgccgaggccttcgcccggcttttcgacaatccgcaggagcgcggcgcggcgttgtgcctggaggtcggtggcgagacggtggtcgacctctggggcggcgtcgcggacaaggacggcgagcagccctggcagcgcgacaccatcctcaatctgttctcctgcaccaagaccttcaccgccgttgccgtgctgcaactggtggccgagggcaagctcgaactggacgcgccggtggcacactactggcccgagttcgccgcggccggcaaggcagcgatcagcgtgcgccagttgctctgccatcgcgccggcctgccggcgctgcgcgagcagatgccgcccgaggcactctacgactggcaggcgatgaccacggcactggccgccgaggagccctggtggacgcctggcgaagcgcacggctatgcaccgattacctatggctggctgctcggcgaggtgatccgccgggtcgacggccgcgagccgggcgaggccatcgtggcgcgcaccgcggcaccgctgggcctggatttccatgtcggcctggacgacagccagttcggccgcgtcgcccacatggcacggagcaagggcagcctcggcgacgctgccgcccagcgcatgctgaagaccatgatgagcgagccattggcgctgaccacccgtgccttcaccaatccgccgtcgatcctcaccagcaccaacaagccggaatggcgacgcatgcagcagccggccgccaatggccatggcaacgcgcgcgcgctcgccggcttctatagcggcctgttgcagggacgtttgctggaagatgaactgctgggccagttggcccacgaacacgcggtaggcgaggatcggaccttgctgacccggacccgcttcggcctcggcaccatgctcgaccaaccgggcgtggccaatgcgacctacggactcggccccaaggccttcggccaccctggggcgggtggctcgatcggcttcgccgatcccgagcgcgacctggctttttcctttgtcagcaacgccttggggccgtatgtgctgatggatccgcgggcgcagcagctggcgcgtgtcgcgggggagtgtctgattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 275 - DNA, 1845 bp, Artificial
  Expression construct
atgccccgaccactttcccaccggaacttgcccatgacgccccaaggccactgtgacagccgtttcgccccgcttgccgaggccttcgcccggcttttcgacaatccgcaggagcgcggcgcggcgttgtgcctggaggtcggtggcgagacggtggtcgacctctggggcggcgtcgcggacaaggacggcgagcagccctggcagcgcgacaccatcctcaatctgttctcctgcaccaagaccttcaccgccgttgccgtgctgcaactggtggccgagggcaagctcgaactggacgcgccggtggcacactactggcccgagttcgccgcggccggcaaggcagcgatcagcgtgcgccagttgctctgccatcgcgccggcctgccggcgctgcgcgagcagatgccgcccgaggcactctacgactggcaggcgatgaccacggcactggccgccgaggagccctggtggacgcctggcgaagcgcacggctatgcaccgattacctatggctggctgctcggcgaggtgatccgccgggtcgacggccgcgagccgggcgaggccatcgtggcgcgcaccgcggcaccgctgggcctggatttccatgtcggcctggacgacagccagttcggccgcgtcgcccacatggcacggagcaagggcagcctcggcgacgctgccgcccagcgcatgctgaagaccatgatgagcgagccattggcgctgaccacccgtgccttcaccaatccgccgtcgatcctcaccagcaccaacaagccggaatggcgacgcatgcagcagccggccgccaatggccatggcaacgcgcgcgcgctcgccggcttctatagcggcctgttgcagggacgtttgctggaagatgaactgctgggccagttggcccacgaacacgcggtaggcgaggatcggaccttgctgacccggacccgcttcggcctcggcaccatgctcgaccaaccgggcgtggccaatgcgacctacggactcggccccaaggccttcggccaccctggggcgggtggctcgatcggcttcgccgatcccgagcgcgacctggctttttcctttgtcagcaacgccttggggccgtatgtgctgatggatccgcgggcgcagcagctggcgcgtgtcgcgggggagtgtctgattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 276 - protein, 614 aa, Artificial
  PlaK-HlyA1 fusion
MPRPLSHRNLPMTPQGHCDSRFAPLAEAFARLFDNPQERGAALCLEVGGETVVDLWGGVADKDGEQPWQRDTILNLFSCTKTFTAVAVLQLVAEGKLELDAPVAHYWPEFAAAGKAAISVRQLLCHRAGLPALREQMPPEALYDWQAMTTALAAEEPWWTPGEAHGYAPITYGWLLGEVIRRVDGREPGEAIVARTAAPLGLDFHVGLDDSQFGRVAHMARSKGSLGDAAAQRMLKTMMSEPLALTTRAFTNPPSILTSTNKPEWRRMQQPAANGHGNARALAGFYSGLLQGRLLEDELLGQLAHEHAVGEDRTLLTRTRFGLGTMLDQPGVANATYGLGPKAFGHPGAGGSIGFADPERDLAFSFVSNALGPYVLMDPRAQQLARVAGECLIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 277 - DNA, 30 bp, Artificial
  Oligonucleotide primer
agaggtaattaaatgagcgtacgcaccgtc

SEQ ID NO: 278 - DNA, 40 bp, Artificial
  Oligonucleotide primer
tgcaagagaatttccacggccatcaatgcgaccggccacc

SEQ ID NO: 279 - DNA, 1692 bp, Artificial
  Expression construct
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgagcgtacgcaccgtcgagcgcggtctcgccggtctcagcgagcacagcgtgcaggtcgacaacctggagatcgcctacctggaaggtggctcggagaagaacccgaccctgttgctgatccacggcttcggcgccgacaaggacaactggctgcgcttcgcccggccgctgaccgagcgctaccatgtggtcgccctcgacctgcccggcttcggcgacagcagcaagccgcaacaggccagctacgacgtcggcacccaggccgagcgagtcgccaatttcgccgccgccatcggcgtgcgccgcctgcacctggccggcaactccatgggcgggcacatcgccgcgctctacgcggcgcgccatccggaacaggtgctatcgctggcgctgatcgacaacgccggggtgatgccggcgcgcaagagcgaactgttcgaggacctggagcgcggcgagaatcccctggtggtgcgccagccggaagacttccagaagctgctcgacttcgtgttcgtccagcaaccgccgctgccggcgccgctcaagcgctacctcggcgagcgcgcggtagccgcgtcggcgttcaacgcgcagatattcgaacaactgcgccagcgctacatcccgctggagccggaactgccgaagatcgaggcaccgaccctgctgctgtggggcgaccgcgaccgcgtgctggacgtctccagcatcgaggtgatgcgtccgctgctgaagcggcccagcgtggtgatcatggaaaactgcggacacgtgccgatggtcgaacgcccggaggaaaccgcgcagcactaccaggccttcctcgacggcgtacggaacgcccaggtggccggtcgcattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 280 - DNA, 1533 bp, Artificial
  Expression construct
atgagcgtacgcaccgtcgagcgcggtctcgccggtctcagcgagcacagcgtgcaggtcgacaacctggagatcgcctacctggaaggtggctcggagaagaacccgaccctgttgctgatccacggcttcggcgccgacaaggacaactggctgcgcttcgcccggccgctgaccgagcgctaccatgtggtcgccctcgacctgcccggcttcggcgacagcagcaagccgcaacaggccagctacgacgtcggcacccaggccgagcgagtcgccaatttcgccgccgccatcggcgtgcgccgcctgcacctggccggcaactccatgggcgggcacatcgccgcgctctacgcggcgcgccatccggaacaggtgctatcgctggcgctgatcgacaacgccggggtgatgccggcgcgcaagagcgaactgttcgaggacctggagcgcggcgagaatcccctggtggtgcgccagccggaagacttccagaagctgctcgacttcgtgttcgtccagcaaccgccgctgccggcgccgctcaagcgctacctcggcgagcgcgcggtagccgcgtcggcgttcaacgcgcagatattcgaacaactgcgccagcgctacatcccgctggagccggaactgccgaagatcgaggcaccgaccctgctgctgtggggcgaccgcgaccgcgtgctggacgtctccagcatcgaggtgatgcgtccgctgctgaagcggcccagcgtggtgatcatggaaaactgcggacacgtgccgatggtcgaacgcccggaggaaaccgcgcagcactaccaggccttcctcgacggcgtacggaacgcccaggtggccggtcgcattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 281 - protein, 510 aa, Artificial
  PlbF-HlyA1 fusion
MSVRTVERGLAGLSEHSVQVDNLEIAYLEGGSEKNPTLLLIHGFGADKDNWLRFARPLTERYHVVALDLPGFGDSSKPQQASYDVGTQAERVANFAAAIGVRRLHLAGNSMGGHIAALYAARHPEQVLSLALIDNAGVMPARKSELFEDLERGENPLVVRQPEDFQKLLDFVFVQQPPLPAPLKRYLGERAVAASAFNAQIFEQLRQRYIPLEPELPKIEAPTLLLWGDRDRVLDVSSIEVMRPLLKRPSVVIMENCGHVPMVERPEETAQHYQAFLDGVRNAQVAGRIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 282 - DNA, 31 bp, Artificial
  Oligonucleotide primer
agaggtaattaaatgcagacgctgttggtcg

SEQ ID NO: 283 - DNA, 44 bp, Artificial
  Oligonucleotide primer
tgcaagagaatttccacggccatcaataagcagcggtttcagcg

SEQ ID NO: 284 - DNA, 1371 bp, Artificial
  Expression construct
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgcagacgctgttggtcgtgggcgatagtatcagcgccgctttgggactggataccagccagggctgggtcgccctgctgcagaagcgcctcgccgacgaaggttacgactaccgggtggtgaacgcctcgatcagcggcgacacctccgcgggtggcctggcgcgcctgccggcgctgcttgccgaggagaagccggcgctggtggtgatcgagctgggaggcaacgacgggctgcgcggaatggcaccggcgcaattgcaacagaatcttgccagcatggcgcaaaaggcccgggcggaaggagcgaaggtgctgctgctgggtatccagttgccaccgaactacggcccgcgctacatcgaggccttttccagggtctacggcgcggtcgcggcgcaggaaaagaccgccctggtgccgtttttcctcgaaggggtcggcggggtccaggggatgatgcaggcggatggcatccatccggcgctcgccgcccagccgaggctcctggaaaatgtctggccgacgctgaaaccgctgcttattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 285 - DNA, 1212 bp, Artificial
  Expression construct
atgcagacgctgttggtcgtgggcgatagtatcagcgccgctttgggactggataccagccagggctgggtcgccctgctgcagaagcgcctcgccgacgaaggttacgactaccgggtggtgaacgcctcgatcagcggcgacacctccgcgggtggcctggcgcgcctgccggcgctgcttgccgaggagaagccggcgctggtggtgatcgagctgggaggcaacgacgggctgcgcggaatggcaccggcgcaattgcaacagaatcttgccagcatggcgcaaaaggcccgggcggaaggagcgaaggtgctgctgctgggtatccagttgccaccgaactacggcccgcgctacatcgaggccttttccagggtctacggcgcggtcgcggcgcaggaaaagaccgccctggtgccgtttttcctcgaaggggtcggcggggtccaggggatgatgcaggcggatggcatccatccggcgctcgccgcccagccgaggctcctggaaaatgtctggccgacgctgaaaccgctgcttattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 286 - protein, 403 aa, Artificial
  tesA-HlyA1 fusion
MQTLLVVGDSISAALGLDTSQGWVALLQKRLADEGYDYRVVNASISGDTSAGGLARLPALLAEEKPALVVIELGGNDGLRGMAPAQLQQNLASMAQKARAEGAKVLLLGIQLPPNYGPRYIEAFSRVYGAVAAQEKTALVPFFLEGVGGVQGMMQADGIHPALAAQPRLLENVWPTLKPLLIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 287 - DNA, 34 bp, Artificial
  Oligonucleotide primer
agaggtaattaaatgaaaatcgaagaaggtaaac

SEQ ID NO: 288 - DNA, 45 bp, Artificial
  Oligonucleotide primer
tgcaagagaatttccacggccatcaatcttggtgatacgagtctg

SEQ ID NO: 289 - DNA, 1941 bp, Artificial
  Expression construct
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcgaaagagttcctcgaaaactatctgctgactgatgaaggtctggaagcggttaataaagacaaaccgctgggtgccgtagcgctgaagtcttacgaggaagagttggcgaaagatccacgtattgccgccaccatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactcgtatcaccaagattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 290 - DNA, 1782 bp, Artificial
  Expression construct
atgaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcgaaagagttcctcgaaaactatctgctgactgatgaaggtctggaagcggttaataaagacaaaccgctgggtgccgtagcgctgaagtcttacgaggaagagttggcgaaagatccacgtattgccgccaccatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactcgtatcaccaagattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 291 - protein, 593 aa, Artificial
  MBP-HlyA1 fusion
MKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTRITKIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 292 - DNA, 33 bp, Artificial
  Oligonucleotide primer
agaggtaattaaatggaaaacagatggcaggtg

SEQ ID NO: 293 - DNA, 48 bp, Artificial
  Oligonucleotide primer
tgcaagagaatttccacggccatcaatgtgtccattcattgtgtggct

SEQ ID NO: 294 - DNA, 1404 bp, Artificial
  Expression construct
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatggaaaacagatggcaggtgatgattgtgtggcaagtagacaggatgaggattaacacatggaaaagattagtaaaacaccatatgtatatttcaaggaaagctaaggactggttttatagacatcactatgaaagtactaatccaaaaataagttcagaagtacacatcccactaggggatgctaaattagtaataacaacatattggggtctgcatacaggagaaagagactggcatttgggtcagggagtctccatagaatggaggaaaaagagatatagcacacaagtagaccctgacctagcagaccaactaattcatctgcactattttgattgtttttcagaatctgctataagaaataccatattaggacgtatagttagtcctaggtgtgaatatcaagcaggacataacaaggtaggatctctacagtacttggcactagcagcattaataaaaccaaaacagataaagccacctttgcctagtgttaggaaactgacagaggacagatggaacaagccccagaagaccaagggccacagagggagccacacaatgaatggacacattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 295 - DNA, 1404 bp, Artificial; identical to SEQ ID NO: 294
  Expression construct

SEQ ID NO: 296 - protein, 414 aa, Artificial
  Vif-HlyA1 fusion
MENRWQVMIVWQVDRMRINTWKRLVKHHMYISRKAKDWFYRHHYESTNPKISSEVHIPLGDAKLVITTYWGLHTGERDWHLGQGVSIEWRKKRYSTQVDPDLADQLIHLHYFDCFSESAIRNTILGRIVSPRCEYQAGHNKVGSLQYLALAALIKPKQIKPPLPSVRKLTEDRWNKPQKTKGHRGSHTMNGHIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 297 - DNA, 34 bp, Artificial
  Oligonucleotide primer
agaggtaattaaatgggcatctttagctataagg

SEQ ID NO: 298 - DNA, 30 bp, Artificial
  Oligonucleotide primer
tgcaagagaatttccggccaacaccacctg

SEQ ID NO: 299 - DNA, 2655 bp, Artificial
  Expression construct
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgggcatctttagctataaggatctggacgaaaacgcgtcaaaggcgctgttttccgacgccttggccatctctacctacgcttaccacaatatcgataacggcttcgatgaaggctatcaccagaccggtttcgggctcggtctgccgctgacgctgatcacggcgctcatcggcagcacccagtcgcagggcggcctgcccggccttccctggaaccccgactccgaacaggccgcgcaggaagcggtgaacaatgccggctggtcggtgatcagcgccacgcagttgggttacgccggcaaaaccgatgcgcgcggcacctactacggcgagaccgccggttacaccaccgcgcaggccgaggtgctgggaaaatatgacagcgaaggcaatctcaccgccattggcatctcatttcgcggcaccagcggcccgcgcgagtcgttgatcggcgataccatcggcgatgtgattaacgatctgctggccgggttcgggccgaaaggctacgccgacggctacacgctgaaggcgttcggcaacttgctgggcgacgtggcgaaattcgcgcaggcccacgggctgagcggcgaggacgtggtggtcagcggccacagcctcggcgggctggcggtcaacagcatggcggcgcagagcgacgccaactggggcggcttctacgcgcagtccaactatgtcgccttcgcctcgccgacccagtacgaagccggcggcaaggtgatcaacatcggctatgagaacgatccggtgtttcgcgcgctcgacggcacctcgctgaccctgccgtcattgggcgttcacgatgcgccgcatacctccgccaccaacaatatcgtcaacttcaacgatcactacgcgtcggacgcctggaatctgttgccgttctccattctcaacattccgacctggctatcccacctgccgttcttctatcaggatggcctgatgcgggtgctgaactccgagttttattcgctgaccgacaaagactcgaccatcatcgtctccaacctgtcgaacgtgacgcgcggcaatacctgggtggaagacctgaaccgcaacgcggaaacgcacagcgggccgacgtttatcatcggcagcgacggcaatgatttgatcaagggcggcaaaggcaatgactatctcgagggccgcgacggcgacgatatcttccgcgacgccggcggctataacctgatcgccggcggcaaaggccacaatatcttcgatacccagcaggcgttgaagaataccgaggtcgcctacgacggcaacacgctttacctgcgcgacgccaagggcggcattacgctggcagacgacatcagcaccctgcgcagcaaagaaacctcctggcttatcttcaacaaagaagtggatcatcaggtaaccgccgccggattgaaatcggactcaggcctcaaagcctatgccgccgccaccggcggcgacggcgatgacgtcctgcaggctcgcagccacgacgcctggctgttcggcaacgccggcaacgacacgctgatcggccacgccggcggcaacctgaccttcgtcggcggcagcggcgatgacatcctgaagggcgtcggcaacggcaacaccttcctgttcagcggcgatttcggccgcgaccagctgtatggcttcaacgccagcgataaactggtgtttatcggcaccgaaggtgccagcggcaatatccgcgactacgccacgcagcaaaacgacgatctggtgctggccttcggccacagccaggtcacgctgatcggcgtctcgctcgatcacatcagcaccgatcaggtggtgttggccggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 300 - DNA, 2655 bp, Artificial; identical to SEQ ID NO: 299
  Expression construct

SEQ ID NO: 301 - protein, 831 aa, Artificial
  LipA-HlyA1 fusion
MGIFSYKDLDENASKALFSDALAISTYAYHNIDNGFDEGYHQTGFGLGLPLTLITALIGSTQSQGGLPGLPWNPDSEQAAQEAVNNAGWSVISATQLGYAGKTDARGTYYGETAGYTTAQAEVLGKYDSEGNLTAIGISFRGTSGPRESLIGDTIGDVINDLLAGFGPKGYADGYTLKAFGNLLGDVAKFAQAHGLSGEDVVVSGHSLGGLAVNSMAAQSDANWGGFYAQSNYVAFASPTQYEAGGKVINIGYENDPVFRALDGTSLTLPSLGVHDAPHTSATNNIVNFNDHYASDAWNLLPFSILNIPTWLSHLPFFYQDGLMRVLNSEFYSLTDKDSTIIVSNLSNVTRGNTWVEDLNRNAETHSGPTFIIGSDGNDLIKGGKGNDYLEGRDGDDIFRDAGGYNLIAGGKGHNIFDTQQALKNTEVAYDGNTLYLRDAKGGITLADDISTLRSKETSWLIFNKEVDHQVTAAGLKSDSGLKAYAAATGGDGDDVLQARSHDAWLFGNAGNDTLIGHAGGNLTFVGGSGDDILKGVGNGNTFLFSGDFGRDQLYGFNASDKLVFIGTEGASGNIRDYATQQNDDLVLAFGHSQVTLIGVSLDHISTDQVVLAGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 302 - DNA, 33 bp, Artificial; identical to SEQ ID NO: 101
  Oligonucleotide primer

SEQ ID NO: 303 - DNA, 44 bp, Artificial; identical to SEQ ID NO: 107
  Oligonucleotide primer

SEQ ID NO: 304 - DNA, 1065 bp, Artificial; identical to SEQ ID NO: 110
  Expression construct

SEQ ID NO: 305 - DNA, 906 bp, Artificial; identical to SEQ ID NO: 111
  Expression construct

SEQ ID NO: 306 - protein, 301 aa, Artificial; identical to SEQ ID NO: 112
  2xHCRF-HlyA1 fusion

SEQ ID NO: 307 - DNA, 28 bp, Artificial
  Oligonucleotide primer
catttaattacctcttaaccagttaatg

SEQ ID NO: 308 - DNA, 15 bp, Artificial
  Oligonucleotide primer
agcgaagaaccgccg

SEQ ID NO: 309 - DNA, 27 bp, Artificial
  Oligonucleotide primer
ggaaattctcttgcaaaaaatgtatta

SEQ ID NO: 310 - DNA, 67 bp, Artificial; identical to SEQ ID NO: 224
  Oligonucleotide primer

SEQ ID NO: 311 - DNA, 17 bp, Artificial
  Oligonucleotide primer
tgtgatctgccgcagac

SEQ ID NO: 312 - DNA, 32 bp, Artificial
  Oligonucleotide primer
catttaattacctcttaaccagttaatgaaaa

SEQ ID NO: 313 - DNA, 28 bp, Artificial
  Oligonucleotide primer
agaggtaattaaatgggaaattctcttg

SEQ ID NO: 314 - DNA, 42 bp, Artificial
  Oligonucleotide primer
ctgcggcagatcacaatcaatatcagccaaactgagtttatc

SEQ ID NO: 315 - DNA, 1383 bp, Artificial
  Expression construct
atgggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgattgtgatctgccgcagactcactctctgggttctcgtcgtactctgatgctgctggctcagatgcgtcgtatctctcttttctcctgcttgaaggaccgtcatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaggaaagtttaagaagtaaggaaattgatggccgtggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 316 - protein, 460 aa, Artificial
  RTX-IFNa2-HlyA1 fusion
MGNSLAKNVLFGGKGNDKLYGSEGADLLDGGEGDDLLKGGYGNDIYRYLSGYGHHIIDDDGGKEDKLSLADIDCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEIDGRGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 317 - DNA, 32 bp, Artificial
  Oligonucleotide primer
agaggtaattaaatgtgtgatctccctgagac

SEQ ID NO: 318 - DNA, 36 bp, Artificial
  Oligonucleotide primer
gtgacggccatcaatttccttcctccttaatctttc

SEQ ID NO: 319 - DNA, 32 bp, Artificial
  Oligonucleotide primer
agaggtaattaaatgtgtgatctgcctcagac

SEQ ID NO: 320 - DNA, 38 bp, Artificial
  Oligonucleotide primer
gtgacggccatcaatttccttactcttcaatctttttt

SEQ ID NO: 321 - DNA, 32 bp, Artificial; identical to SEQ ID NO: 319
  Oligonucleotide primer

SEQ ID NO: 322 - DNA, 38 bp, Artificial
  Oligonucleotide primer
gtgacggccatcaatatccttccttcttaatccttttt

SEQ ID NO: 323 - DNA, 32 bp, Artificial; identical to SEQ ID NO: 319
  Oligonucleotide primer

SEQ ID NO: 324 - DNA, 38 bp, Artificial; identical to SEQ ID NO: 322
  Oligonucleotide primer

SEQ ID NO: 325 - DNA, 1347 bp, Artificial
  Expression construct
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgtgtgatctccctgagacccacagcctggataacaggaggaccttgatgctcctggcacaaatgagcagaatctctccttcctcctgtctgatggacagacatgactttggatttccccaggaggagtttgatggcaaccagttccagaaggctccagccatctctgtcctccatgagctgatccagcagatcttcaacctctttaccacaaaagattcatctgctgcttgggatgaggacctcctagacaaattctgcaccgaactctaccagcagctgaatgacttggaagcctgtgtgatgcaggaggagagggtgggagaaactcccctgatgaatgcggactccatcttggctgtgaagaaatacttccgaagaatcactctctatctgacagagaagaaatacagcccttgtgcctgggaggttgtcagagcagaaatcatgagatccctctctttatcaacaaacttgcaagaaagattaaggaggaaggaaattgatggccgtcaccaccaccaccaccacggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 326 - DNA, 1188 bp, Artificial
  Expression construct
atgtgtgatctccctgagacccacagcctggataacaggaggaccttgatgctcctggcacaaatgagcagaatctctccttcctcctgtctgatggacagacatgactttggatttccccaggaggagtttgatggcaaccagttccagaaggctccagccatctctgtcctccatgagctgatccagcagatcttcaacctctttaccacaaaagattcatctgctgcttgggatgaggacctcctagacaaattctgcaccgaactctaccagcagctgaatgacttggaagcctgtgtgatgcaggaggagagggtgggagaaactcccctgatgaatgcggactccatcttggctgtgaagaaatacttccgaagaatcactctctatctgacagagaagaaatacagcccttgtgcctgggaggttgtcagagcagaaatcatgagatccctctctttatcaacaaacttgcaagaaagattaaggaggaaggaaattgatggccgtcaccaccaccaccaccacggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 327 - DNA, 1347 bp, Artificial
  Expression construct
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgtgtgatctgcctcagactcacagcctgggtaacaggagggccttgatactcctggcacaaatgcgaagaatctctcctttctcctgcctgaaggacagacatgactttgaattcccccaggaggagtttgatgataaacagttccagaaggctcaagccatctctgtcctccatgagatgatccagcagaccttcaacctcttcagcacaaaggactcatctgctgctttggatgagacccttctagatgaattctacatcgaacttgaccagcagctgaatgacctggagtcctgtgtgatgcaggaagtgggggtgatagagtctcccctgatgtacgaggactccatcctggctgtgaggaaatacttccaaagaatcactctatatctgacagagaagaaatacagctcttgtgcctgggaggttgtcagagcagaaatcatgagatccttctctttatcaatcaacttgcaaaaaagattgaagagtaaggaaattgatggccgtcaccaccaccaccaccacggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 328 - DNA, 1188 bp, Artificial
  Expression construct
atgtgtgatctgcctcagactcacagcctgggtaacaggagggccttgatactcctggcacaaatgcgaagaatctctcctttctcctgcctgaaggacagacatgactttgaattcccccaggaggagtttgatgataaacagttccagaaggctcaagccatctctgtcctccatgagatgatccagcagaccttcaacctcttcagcacaaaggactcatctgctgctttggatgagacccttctagatgaattctacatcgaacttgaccagcagctgaatgacctggagtcctgtgtgatgcaggaagtgggggtgatagagtctcccctgatgtacgaggactccatcctggctgtgaggaaatacttccaaagaatcactctatatctgacagagaagaaatacagctcttgtgcctgggaggttgtcagagcagaaatcatgagatccttctctttatcaatcaacttgcaaaaaagattgaagagtaaggaaattgatggccgtcaccaccaccaccaccacggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 329 - DNA, 1347 bp, Artificial
  Expression construct
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgtgtgatctgcctcagactcacagcctgggtaataggagggccttgatactcctggcacaaatgggaagaatctctcatttctcctgcctgaaggacagatatgatttcggattcccccaggaggtgtttgatggcaaccagttccagaaggctcaagccatctctgccttccatgagatgatccagcagaccttcaatctcttcagcacaaaggattcatctgctgcttgggatgagaccctcctagacaaattctacattgaacttttccagcaactgaatgacctagaagcctgtgtgacacaggaggttggggtggaagagattgccctgatgaatgaggactccatcctggctgtgaggaaatactttcaaagaatcactctttatctgatggggaagaaatacagcccttgtgcctgggaggttgtcagagcagaaatcatgagatccttctctttttcaacaaacttgcaaaaaggattaagaaggaaggatattgatggccgtcaccaccaccaccaccacggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 330 - DNA, 1188 bp, Artificial
  Expression construct
atgtgtgatctgcctcagactcacagcctgggtaataggagggccttgatactcctggcacaaatgggaagaatctctcatttctcctgcctgaaggacagatatgatttcggattcccccaggaggtgtttgatggcaaccagttccagaaggctcaagccatctctgccttccatgagatgatccagcagaccttcaatctcttcagcacaaaggattcatctgctgcttgggatgagaccctcctagacaaattctacattgaacttttccagcaactgaatgacctagaagcctgtgtgacacaggaggttggggtggaagagattgccctgatgaatgaggactccatcctggctgtgaggaaatactttcaaagaatcactctttatctgatggggaagaaatacagcccttgtgcctgggaggttgtcagagcagaaatcatgagatccttctctttttcaacaaacttgcaaaaaggattaagaaggaaggatattgatggccgtcaccaccaccaccaccacggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 331 - DNA, 1347 bp, Artificial
  Expression construct
tcccaaaactcatgttggtaaagtatcagaatttcatggaggtaaaattgataaacagttagcgaataaaatttttaaacaatatcaccacgagttaataactgaagtaaaaagaaagtcagattttaatttttcattaactggttaagaggtaattaaatgtgtgatctgcctcagacccacagcctgggtaataggagggccttgatactcctggcacaaatgggaagaatctctcctttctcctgcctgaaggacagacatgactttggattcccccaggaggagtttgatggcaaccagttccagaaggctcaagccatctctgtcctccatgagatgatccagcagaccttcaatctcttcagcacaaaggactcatctgctacttgggaacagagcctcctagaaaaattttccactgaacttaaccagcagctgaatgacctggaagcctgcgtgatacaggaggttggggtggaagagactcccctgatgaatgtggactccatcctggctgtgaagaaatacttccaaagaatcactctttatctgacagagaagaaatacagcccttgtgcctgggaggttgtcagagcagaaatcatgagatccttctctttatcaaaaatttttcaagaaagattaaggaggaaggaaattgatggccgtcaccaccaccaccaccacggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 332 - DNA, 1188 bp, Artificial
  Expression construct
atgtgtgatctgcctcagacccacagcctgggtaataggagggccttgatactcctggcacaaatgggaagaatctctcctttctcctgcctgaaggacagacatgactttggattcccccaggaggagtttgatggcaaccagttccagaaggctcaagccatctctgtcctccatgagatgatccagcagaccttcaatctcttcagcacaaaggactcatctgctacttgggaacagagcctcctagaaaaattttccactgaacttaaccagcagctgaatgacctggaagcctgcgtgatacaggaggttggggtggaagagactcccctgatgaatgtggactccatcctggctgtgaagaaatacttccaaagaatcactctttatctgacagagaagaaatacagcccttgtgcctgggaggttgtcagagcagaaatcatgagatccttctctttatcaaaaatttttcaagaaagattaaggaggaaggaaattgatggccgtcaccaccaccaccaccacggaaattctcttgcaaaaaatgtattattcggtggaaaaggtaatgacaagctgtacggcagtgagggggcagatctgcttgatggtggagagggggatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaaagtggccggataatcacacctgattcccttaaaaaggcacttgagtatcaacagcgtaataataaggcaagttatgtgtatgggaatgatgcattagcctatggaagtcagggtgatcttaatccattaattaatgaaatcagcaaaatcatttcagctgcaggtagcttcgatgttaaagaggaaagaactgcagcttctttattgcagttgtccggtaatgccagtgatttttcatatggacggaactcaataaccctgaccacatcagcataa

SEQ ID NO: 333 - protein, 395 aa, Artificial
  IFNA1-HlyA1 fusion
MCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKEIDGRHHHHHHGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 334 - protein, 395 aa, Artificial
  IFNA8-HlyA1 fusion
MCDLPQTHSLGNRRALILLAQMRRISPFSCLKDRHDFEFPQEEFDDKQFQKAQAISVLHEMIQQTFNLFSTKDSSAALDETLLDEFYIELDQQLNDLESCVMQEVGVIESPLMYEDSILAVRKYFQRITLYLTEKKYSSCAWEVVRAEIMRSFSLSINLQKRLKSKEIDGRHHHHHHGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 335 - protein, 395 aa, Artificial
  IFNA16-HlyA1 fusion
MCDLPQTHSLGNRRALILLAQMGRISHFSCLKDRYDFGFPQEVFDGNQFQKAQAISAFHEMIQQTFNLFSTKDSSAAWDETLLDKFYIELFQQLNDLEACVTQEVGVEEIALMNEDSILAVRKYFQRITLYLMGKKYSPCAWEVVRAEIMRSFSFSTNLQKGLRRKDIDGRHHHHHHGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 336 - protein, 395 aa, Artificial
  IFNA21-HlyA1 fusion
MCDLPQTHSLGNRRALILLAQMGRISPFSCLKDRHDFGFPQEEFDGNQFQKAQAISVLHEMIQQTFNLFSTKDSSATWEQSLLEKFSTELNQQLNDLEACVIQEVGVEETPLMNVDSILAVKKYFQRITLYLTEKKYSPCAWEVVRAEIMRSFSLSKIFQERLRRKEIDGRHHHHHHGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 337 - DNA, 20 bp, Artificial
  Oligonucleotide primer
atgacaacaataaccactgc

SEQ ID NO: 338 - DNA, 25 bp, Artificial
  Oligonucleotide primer
gaggtaattaaatgacaacaataac

The invention claimed is:

1. An isolated nucleic acid molecule comprising a first nucleic acid sequence operably linked to a second nucleic acid sequence, wherein:
   (a) the first nucleic acid sequence comprises a nucleotide sequence having at least 70% nucleotide sequence identity to any one of the nucleotide sequences as set forth in SEQ IDs NOs: 1 and 3-27 in which SEQ ID NO: 2 is present, or the complements thereof, and
   (b) the second nucleic acid sequence is located 3' to the first nucleic acid sequence and comprises a polynucleotide encoding at least one peptide or protein of interest heterologous to a hemolysin Type I secretion system.

2. The isolated nucleic acid molecule of claim 1, wherein the nucleic acid molecule further comprises a third nucleic acid sequence located either
   (a) 3' of the second nucleic acid sequence, or
   (b) 3' to the first nucleic acid sequence and comprising an insertion of the second nucleic acid sequence, wherein the second nucleic acid sequence and third nucleic acid are operably linked, and said third nucleic acid sequence encodes a hemolysin Type I secretion system hemolysin A (HlyA) polypeptide or a fragment thereof, wherein said HlyA polypeptide
   (i) is encoded by the nucleotide sequence as set forth in SEQ ID NO:29 or a fragment thereof, wherein the fragment comprises at least the nucleotide sequence as set forth in SEQ ID NO:30, or the complement thereof, or
   (ii) has a nucleotide sequence that has at least 70% sequence identity to the nucleotide sequence as defined in (i); or
   (iii) has a nucleotide sequence that encodes a polypeptide which has at least 91% sequence homology to the polypeptide encoded by the nucleotide sequence of (i).

3. The isolated nucleic acid molecule of claim 2, wherein the third nucleic acid sequence has a nucleotide sequence selected from the group consisting of SEQ ID NOs: 30-40, and fragments thereof, wherein the fragments comprise at least the sequence as set forth in SEQ ID NO:30, or the complements thereof.

4. The isolated nucleic acid molecule of claim 2, wherein the first nucleic acid sequence has a nucleotide sequence selected from the group consisting of SEQ ID NOs:1 and 3-27 or the complements thereof, and the third nucleic acid sequence has a nucleotide sequence selected from the group consisting of SEQ ID NOs: 29-40.

5. The isolated nucleic acid molecule of claim 2, wherein the nucleic acid molecule further comprises at least one fourth nucleic acid sequence encoding for either one or both of:
   (i) an affinity tag, wherein the affinity tag is encoded by a nucleotide sequence that is operably linked to the 5' or 3' end of the second or third nucleic acid sequence; and
   (ii) a protease cleavage site, wherein the protease cleavage site is encoded by a nucleotide sequence that is operably linked to the second nucleic acid molecule and the third nucleic acid molecule such that it is located between the second and third nucleic acid sequences.

6. The isolated nucleic acid molecule of claim 1, wherein the nucleic acid molecule comprises or consists of a nucleic acid sequence as set forth in any one of SEQ ID NOs: 46, 71, 74, 79, 84, 89, 93, 98, 103, 110, 115, 120, 125, 130, 135, 140, 145, 220, 227, 234, 239, 244, 249, 254, 259, 264, 269, 274, 279, 284, 289, 294, 299, 304, 325, 327, 329, and 331.

7. A vector comprising the nucleic acid molecule of claim 1.

8. A host cell comprising the nucleic acid molecule of claim 1.

9. A recombinant peptide or protein encoded by a nucleic acid molecule according to claim 1.

10. The recombinant peptide or protein according to claim 9, wherein the recombinant peptide or protein consists of an amino acid sequence selected from the group consisting of SEQ ID NOs: 46, 68, 73, 76, 81, 86, 91, 95, 100, 105, 113, 117, 122, 127, 132, 137, 142, 147-150, 222, 229, 236, 241, 246, 251, 256, 261, 266, 271, 276, 281, 286, 291, 296, 301, 306, 316, and 333-336.

11. A method for expression of a recombinant peptide or protein, wherein the method comprises:
   (a) introducing the nucleic acid molecule of claim 1 into a Gram-negative prokaryotic host cell wherein the nucleic acid molecule encodes the recombinant peptide or protein; and
   (b) cultivating the Gram-negative prokaryotic host cell in a culture medium under conditions that allow expression of the recombinant peptide or protein.

12. The method according to claim 11, wherein the method further comprises recovering the expressed peptide or protein from either one or both of the host cell and the culture medium.

13. The method according to claim 11, wherein the method further comprises secretion of the expressed recombinant peptide or protein into the culture medium by cultivating the host cell under conditions that allow secretion of the recombinant peptide or protein into the culture medium.

14. The method of claim 11, wherein:
   (a) the host cell is a Gram-negative prokaryotic cell;
   (b) the host cell expresses HlyB and HlyD;
   (c) the expression is performed in minimal culture medium;
   (d) the culture medium comprises 1-40 mM of $Ca^{2+}$;
   (e) the recombinant peptide or protein is purified using a method selected from affinity chromatography, ion exchange chromatography, reverse phase chromatography, size exclusion chromatography, and combinations thereof;
   (f) the method comprises treatment of the recombinant peptide or protein with a protease suitable for cleavage of a protease cleavage site within the recombinant peptide or protein; or
   (g) the method comprises a step as defined in (f) followed by purification of the recombinant peptide or protein.

15. An isolated nucleic acid molecule comprising:
   (a) a first nucleic acid sequence having (i) the nucleotide sequence as set forth in SEQ ID NO: 34 or the complement thereof, (ii) a nucleotide sequence that has at least 70% sequence identity with the nucleotide sequence of (i), or (iii) a nucleotide sequence encoding the polypeptide with the amino acid sequence set forth in SEQ ID NO: 46; and
   (b) a second nucleic acid sequence operably linked 5' or 3' to the first nucleic acid sequence, wherein the second nucleic acid sequence is heterologous to a hemolysin Type I secretion system and wherein the second nucleic acid sequence encodes for at least one peptide or protein of interest.

16. The isolated nucleic acid molecule of claim 15, further comprising at least one third nucleic acid sequence encoding for at least one of an affinity tag and a protease cleavage site, wherein the at least one third nucleic acid sequence is operably linked 5' or 3' to at least one of the first nucleic acid molecule and the second nucleic acid molecule.

17. The isolated nucleic acid molecule of claim 15, wherein the nucleic acid molecule has the nucleotide sequence as set forth in any one of SEQ ID NOs: 67, 72, 75, 80, 85, 90, 94, 99, 104, 111, 116, 121, 126, 131, 136, 141, 146, 221, 228, 235, 240, 245, 250, 255, 260, 265, 270, 275, 280, 285, 290, 295, 300, 305, 315, 326, 328, 330, and 332.

18. A vector comprising the nucleic acid molecule of claim 15.

19. A host cell comprising the nucleic acid molecule of claim 15.

20. A recombinant peptide or protein encoded by the nucleic acid molecule of claim 15.

21. The recombinant peptide or protein according to claim 20, wherein the recombinant peptide or protein consists of an amino acid sequence selected from the group consisting of SEQ ID Nos. 46, 68, 73, 76, 81, 86, 91, 95, 100, 105, 113, 117, 122, 127, 132, 137, 142, 147-150, 222, 229, 236, 241, 246, 251, 256, 261, 266, 271, 276, 281, 286, 291, 296, 301, 306, 316, and 333-336.

22. A method for expression of a recombinant peptide or protein, wherein the method comprises:
   (a) introducing the nucleic acid molecule of claim 15 into a Gram-negative prokaryotic host cell, wherein the nucleic acid molecule encodes the recombinant peptide or protein and
   (b) cultivating the Gram-negative prokaryotic host cell in a culture medium under conditions that allow expression of the recombinant peptide or protein and secretion of the recombinant peptide or protein into the culture medium.

23. The method according to claim 22, wherein the method further comprises recovering the expressed peptide or protein from either one or both of the host cell and the culture medium.

24. The method according to claim 22 wherein:
   (a) the host cell is a Gram-negative prokaryotic cell;
   (b) the host cell expresses HlyB and HlyD;
   (c) the expression is performed in minimal culture medium;
   (d) the culture medium comprises 1-40 mM of $Ca^{2+}$;
   (e) the recombinant peptide or protein is purified using a method selected from affinity chromatography, ion exchange chromatography, reverse phase chromatography, size exclusion chromatography, and combinations thereof;
   (f) the method comprises treatment of the recombinant peptide or protein with a protease suitable for cleavage of a protease cleavage site within the recombinant peptide or protein; or
   (g) the method comprises a step as defined in (g) followed by purification of the recombinant peptide of protein.

* * * * *